United States Patent 7,557,198 (ACUTE MYELOGENOUS LEUKEMIA BIOMARKERS) - sequence listing, part 2

SEQ ID NO: 31 - DNA, 218972 bp, Artificial Sequence
  Synthetic BAC sequence
gcttcagtcatttgaataccacctttatgattttaccattcctgcatttcaatacacacatacttagttttcttcctttccttcctttccttcccctccttctcttccctcccttccctccctttcttcctcctttctttccttttccttcctcctttctttccttttccttccttcttttcttttctttctttccttccttccttctctttcctccttccttccttccttccttccttccttccttccttccttccttccttccttccatccttccttctctctctctctctccctttccctctttccttctcttctcttcttttctcttctcttttctcttctcttctttccttggagtcttgctctctcgcccgggctagagtgcagtggcgcgatctctgctcactgcaagctccgcctcccgggttcacgccattctcctgcctcgagtagctgggactacaggcgcccgccaccacgcccggctaatttttttgtatttttacttgagacggggtttcaccgtgttagccaggatggtctcgatatcctgacctcgtgatccgcccgcctcggcctcccaaagtgctgggattacaggcgtgagccaccccgcccggcccttagttttcttaattgaataagtttttaaaacaaaacatttactttagcttctttctaagcaattatatttctgaaatcatatttggtgtgctagttttctaacacatattgaaataaatataaacattaaaataactaccaaaatgaaaatgtccatgaactgcttaaactcagtggtgtatataccacaccttagtaaatattgccctagccattactggaaaaataaaatacgtaagtttctctgaatcctagttggtgtgttgaacacctctgttgaatttcttcctcaggtgtgtactagcgtcatggtatcttgtaccatcattgtacccaccccctctattttgtgttgattttacagggctccaacctacagtattttattctattttatttttttgagatggggtcttgctgtgttgcccaggctggagtgcagtggtgcaatcttggctcactgcaacctatgcctcccgggttcaagtgactctcgtgcctcagcttcccgagtagctgggattacagatgagcatgcccagctaatttttgtatttttactagaggcagggtttcatcatgttggccaggctggtcttgaactcctgacctcaagtgatccacccacctcagcctcccaaagtgctgggattataggcgtaagcccccatgccccgccttcaacctacagtatttgaaagataaaatatgaaattttatctttagtatttgtgattttgtgcatagtaagagattctcaaatatttgtgtacctaatattcttgaatattttctaactattctcaaatatttatagtacctaagaatgaacatatactctaccatttgaggtgattaattttggcctactggtggattaaaagaatttttaacagtgtcgacatgacgctagacacaatccacatcaataaaaaatcattatttgaataagacgaagataatgctgaaaatataaaaagactaaaatatcagttctctctatttgtattaactttgagaattcagtgtttcaaaagtgtgaagggtcttaactacaaactttgatttaaaactgagacttctttgaggaaattgttttgctttaatccgtccttctaaaaatgggatttagagaatttggaggaaactgtatacaataaagttttttttttcacctaagctttctagttaatcatttgacacagcagtctgaagattttaaattccagttgccactgccattctttccactagaatgttgcttgagatatgggccaattttacttagcacctagcctggtacctggtgtatagtaggtgctcatttaaggcttattttacaactaagcgaattcctaccttttctctatgttacagaatatcactaacaccaagttaagatctataagagggaatcagaaaatagaatattagtttcactttcttggaacacacatgaaggagcaaatctttacaaaactgtcttttttcactattcatggtcaatatttgaattatattatttttatgcactgcttatttatcctttcctcaatattgaacttcagttctcatcagaattcgctttttcttaaccaaggattcctctcacacactatacatgcagactttttcattaagtcattttattgcaatacctgaaagcaacaagaatctgtactctccaagtgagtgaatagcagagaatgtttgctaagtgattttaaaaaatgtcttcattttagaaaatttgcccaagttttccatacttgaaaaaaaacctagttgtcattctctctacatgattttatatcttgctttttctgcttagtaaatattttcccatagaattaaaaattttgcaggaacaatctctaatttgaattgaattaatttaattcaattgaattgaattaaaatacctcagaggaatacaaattcagaaccttgaagattggttgctgtcctccaccatgccttgagggtatgtgatgtgaaaatttggtttaaaaatggaaattatttaaaatgaattatatcaaactgtattttggtttggcctttgttaaatataatctttttttttttttttttgagccgagtctcgcgatctcagctcactgcaatctctgcctcctgggtttgaacaagctattctcctgcctcagcctccgaagtagttgggactatgggtgcgtgccaccacacccggctaattttttgtattttcagtagagacggggtttcaccgtgttagccagaatggtcttgatctcttgacctcgtgatccacctgcctcagcctcccaaagtgctgggattacaggcgtgagcctctgtgcccagcctaaatataatcttttaaggttgggtgtggcagcttatggctgtaatcccagcactttgggaggctgaggcaggaggctcacttgaggccagaaattggagaccagcctgggcaacacagggagactcttgggaggctgaggcaggaggctcacttgaggcccggaattggagaccagcctgggcaacacagggagactctttctctacaaaattttttttaaaaattagctgggcatggtggcttgtgcctgtagtcccagctattcgggaggctgaggtggcaggatcacttgagcacaggaggttgaggctgcagtaagctatgatcattagtgcactcccctctgggtgacagagtgagaccttgtctcaaaaataaataaataaataaataaaaaatatattcattttgatcatcttgagaatagtctgacaaagtttattgctaactagatgaatcctgaaattcttggtggtgatggttctagagataaaaagtatgaagcaagcctgagcctattaagtgctttatcctttatgtaccagtatcaaactgtgttgctatttatgttcctgaatgagataggaatttcttcagattcagagaagggaaaatgacagaaacgacaacaaaaatgagaactacactttttttttttttttttttttttgaggcggagtctcggtctgaggcccaggctggagtgcagtcgcgcgatctcggctcactgcaagctccgtctcccgggttcacgccattctcctgcctcaacctctggagtagctgggactacaggcgcccgccaccacgcccggctaattttttgtatttttagtagagacggggtttcgccgtgttagccaggatggttgcatctcctgacctcgtgatccgcccgcttcggcctccccaagtgctgggattacagacagacgtaagccaccgcgcccggcctctgagaactacacttttaaaacagcccatggtcacgcgttttgaagggctggggaaatactgagggattttacctgcttttggggtggggggtgggggcagaacaagaaaatctgattgaagacagcatgaagtatcaaaataacccttggccactttggctagtgcccgtaggaatataaacaggtgggccacaaatccaagccttgatgaatgacctatgccagcaccaatttcctccctccttctggatcagagcctgtttccttccaaagtggtggacccccgaaatcttacaggcttttttttttttttttttttcctctgtctcactctgtcgcccaggtagagatcaatggcatgatctcggttcattgcaacctctgcctcccgggttcaagcggttctcttgcctcagcctcctgagtagctgggactacaggcagccgccaccatacccggctaatttttttaattttagtagagacggggtttcaccatgttggctaggctggtctcgaactcctagcctcatgtgatccgcccgcctcggcctcccaaagtgctgggattacaggcgtgagtcaccatgcccagccgagtctaactttctttacgatttcctggggtcccagctggacggagtctcatccctgccccccttactgggaggaaaagggaatgcacctcctccatgagcctcagctgcactttgaggcacctggaatccccggatgtggagcgagtctctgaaatgcagaacccgaggggccaacccatggactgtgatgggtaaaaggggagagagcactaaagaggccaagtagggaggacattatccctttccccttttattattattttttgttagaaaaaggcaggtggacatatttagcttgcgaagcttgcacaaggaaaatccagagcgtctccagaataaggatcccacgagagaacgtggacacaagtaggccctcagccagccttgtacccacaggcccaacaggccacttggctatgaggccagagcgtcgccataggggcccgaacgctagcgtttagggaatccgcaggctagaagtggaggcgggacgccactggtcgtctgagcgctgattggctggtggcgctagtcaccagccaatcgtcaacagacgccatttgttgttggagccacgcacctgacgcagtgggcgtcttgcacgtgcagccgtttaagtcgcgtgggcgcctgcgagggcttgggagagcaagccgcggagaggtgagtgggccgcttttctacgggaactggcctgaactcggccgtacgggctccccagtaaccgacctttggccaaagtgtggatggagtaggaggagttttgaagccgtccttcgaagcctttctgcctcggggtctcagagtcccacgggtgcccaaagtctgggcttgaggcctgcagaggaggcgaaggggccttattcctggcttcttcactgcgttttctctgaacagacatggtccgagtaccatttgtgtacaaatccttcttgatgaagctggttgtcctttgtcggcaggatttgggcaaccatacccttcttcccttccccactaaaatccaaggcctccctcttcaccgagtcgccgcccccctacccagtcgactcccgtacccctgtccccgcccccacgcacgccacaaacaccccaaagcaaacatcctatccaccttggatgttaatcatgcgaagggagaaatcttaagtagtttctgaaaaaagttgcctctcccttaatattcagtaagtcgtttggggaccctttgagggaggagataaagtctatgaacagatgtttgggaaaagcctaagtcttgctggggacatggcgattgctagaatgactaggtaagaggttcaactagtttctaaagctaagaaaggatggagataaatgccacctttagataagaagagacctaattccttctttggaaaaaacttttggggtatcagcacctagttgggtagtttcaagatgtatgtgaaacaatgagtttatgcttttaaagttatgattctgatctaattgagtccaaatgtgcatttttttttttttatgaatagaacttgaagccaccatgggagatgaagattgggaagcagaaatcaaccctcatatgtcttcctatgttcccatatttgagaaggtaataacatttaaagtttagttattaaatgctacggattttatcaaagttgaaaatcactgtggtgagagttctaaattatacagtctgtgtcagtgtttatctccatgtgattgttattaactattatatggggaataagagacaacctaagcctcgtataggatacaatagcttgaggcaatttgataattaaaagctaaaatagatgtaaaaatattaatgacctaatttaaatctcaatgatttaggacttcctcaggtgaaagcaaacttgggcaaatgtggttgatatcagtgaaagacgcttgtatggaaaattgaaaacaataattacgttttgggagatattttaaattctgaaaattgattttgtgcaaggagggttctcaggataaatgatactaggctgattgagttggtaacatcagtttgtatgaatcttcagatcttttttcttaatggcatttggggagttacattgtaatttaggggacagtggggtaagttttttgggcttcagttctgacttggaaattggctttaaaaagatgaatagaaggtactttaaaagataatagattatttttgcatgtgttacttactatatggtgtctctacaagttgatttttttgttccccttcagaatttccagtttgagtgtatgtcagttctgacactttctgatttcaagttttgccttagtggaagttcttattttagacaaaaatataaaatatgcaatcttttgtcttagttgaatttgatctatatgtgaagtttatattaaaatacccaaaatactaatataaatttatcatgtttcttttcttggaactttttaaaagaaataacatgttacctttttttttattttttaaaatttttgtagagatgaagtctcactatattgcccagactggtttccaactcctgagttcaggcgacattctcaaagtgttgggattacaggcgcaagccattgcacctggactgtgttatctttttatagttctcttctcataataaaaatatagcttttttgggaaaagtggagaaagtcacctacaaatcttgcccaatagacaagcactcctgttaaaatttttagtcaattttcttctgttttttccaaacattttttgtttgtttttgatacagtgtcttgctctgtcacccaggctggagtgcactcatgcagtgtgggctcactgcagcctctgccttctgggttcaagcaattctcctgcctcaacctccctcagcgagactacaggcgcatgccaccacgcccagctaatttttgtatttttagtagagatggggtttccccatgttggccaggctggtcttgaactcctgatctcaggtgattcactcacctgggccttccaaaatgctggattacagtcatgagccaccgtgcccagcccaaacatgttttatatagttttgatgatagtatataacagtaatttttttttttttttgagatggagtctcactctattgcccaggctggagtgcagtggtgcagtctcagctcactgcaacctctgcctcctaggttcaagcgattttcctgcctcagcctcccaagtagctgggactacacgtgtgtgccaccacgccccgctaatttttttttttttttttttgtatttttagtagacacagggtttcactatgttggccaggctggtctcaaactcctgacctcaggtgatcctcccactttggcctcccaaagtgctgggattacaggcatgggccaccacacccagccatataacagtaacttttgaatccatctttcttgacacttcagcactaactattccatattacaacttttgtgggaatttcagtggtgttagcttctcactgtgtattgtcattaatgtttacatcttacttgttttaatttggtaatttttttcaaaaatggaattacttgttcagaggacattttttatcattctttttcctccttgttctcaatagatttgttataacacaaagtttaattcacagatagatactttattccccctggtcttaatagccatctgtccaatttcttttttcttagtttgagatttttgtcttcatgaagtgtttaagcagcacactgcactatagcgtgttgtgcatatttattgcattgggtttctgaaattaaggatgactgtcaaatctttcaaatttccctttttgggatctttatgctattcaataacatagtttcttcacattgggaatactaaattgaatatgttgaccagtctaccttatgatgcttaatacatttgtgttgggtgaatttgtagtgtatcttttgcatttgtctgcaaacttaacacctggtgttgtgctggttgtgccattagttctatgcttagttgactcgaaggaacatggtgcaatcaggatctttatttgccttcctaggttgaataaaaagtgcaggatggccaggtgcggtggttcatgcctgtaatcccagcactttgggaggctgagacagccagatcacttgaggccaggagttcgagaccagcctggccaacatagcaaaaccccttctctactaaaaatacaaaaaattagctgggagtggtggcacacgccagtagcctcagctacttgggaggctgaggcaggagaatctcttgaaattgggaggtggagactgcagtgagccaagtccgggcagctgcactccagcctgggcaatggagcaagactctgtctgaaaaaaaaaaaaagtgcagaaactagagatgaatacattacatttttatgtagaacaaatctaaagtctttcattccgtttcttttaaagacaccattttgatttgttctaactgaatttggttttcaagaaaaagctggccttctcttttatagcggctttatctgtgatcatccttttctgagtgcttctcaggagctttatttggagacttaatgttgacatacgcttatataattttgaaataatttgtcattgttctagtataacagatagaattttgggtagaacttctcaattctaaattttaaagtgagtgtaccacctgggaatagaacagcgaaagatgtgaagttaagaaagattttataatgtggcaattatatagtccagaaatctcaaccattaggcatttgcacgttgcctgcaggcttattggggtgagtgttagaatggatgggtatggtgagtgtattagataattccgttgcttacttactagctgtgaggcctcttgttaactgaccgtgaatgtaagcctgtatagtgatcacttctgtctgatctatttgccatttttgtggcacatttcagaaggcaaaatctcttgtggttaaagtggaaacagtaattgagtaattagaccatccacaattataattttattaagcagcagtagcaatgttagcaataattgttgagataagaaaataaacatatatatgatattacaaaattgaaagtaagaatacaggtgaaaaaaatgtgttcatcaaaatgcaaaaggattatttgtagctgcatgtgagaacacttatgtgttaaacattcgaaatttctgaattggtgcatttgggtggtttgagagataataatggtttacagctaagtattttaagaggtaagctaaagacaagacctatgattcattcaacatatttttgagttctagtaggtgctggagagagagtggtgaatataaggtgcttgctgttacattgtattttactggagaagacagaataagcgcgtttgagaaccaaataattatagtgaaaagtactataaaaaattagagaaatgtgtgtgtgagactggtgtggggtggatttagttggagagggaaggcttctctcagacagtgactcatgagcctgagacttaaaggagtcccagcaggacatcaggtgcaaaggttctcaaggaacctttgagaaggaggagggaacaaacttggggtattagggcaacaagaaggccaatgtgttagttttctgtggctgctataacaaattaacacaaactgggtaacttaaagcaacataaatttattctcatagttctggaagcctgaagttaaaaatcaaggtgtcagcagcgctgccctccctctggaggttctgggacagaatctttgcttcttctagcttctagtggctaagggcattcctcggcttgtggctgcatatctcttagctctgtcttcacattgcacctcctttgtgggtctttgtgttatttccctctgcctctctattataaggacacttgtgatggcaattaggactcatgccgataatccagggtaatctcatctcaaaatctttaacttaatttcatctgctgtgaccccttttctctctctttcttttcttttttgagacagagacttgttctgtcacctaggctggagtgcagtggcgcaatctcggctcccttcaagctccacctcctgggttcaggcgattctcctgcctcagtctcctgagtagctgggattacaggtgcccgccaccatgcctggctaatttttgtatttttagtagagatggggttacaccatgttggacaggctggtcttgaactcctgacctcaggtgatctggctgcctcggcttcccaaagttctggaattacaggcgtgagccaccgcgcccaaccagttaagcttttttaatgataaaattctgttggaaattatttttgatgtattttttcaaaattcatcttggaatttgtaagttggatgtatgtgggatattaagttccatagcttgaagcttaataataagtttttcagttctttagtgtaagagtgttttataacacttgtaaaaccagcctttttttttttttttttgcctctattcactctatagtactttgagccttacaaacaagaaaaaagtcttcagattttaaatagaaaatattggataattgttcttgttttaatgtctgtggtagtaataaactggaacttttttttactgtagcaattaccaaaaccccaagtcatttcaagtatgttgttatttttgtgcccttaatgatgactcggaaaaatgtttggatgactcttgagctttttaaaagtagttttaaaagtcagtgtctttgagaaagaaattttagcaaatagatgttacctaaagaagcctaccttggtgcattctctctaggtttgggacttagttaaatgaacttatttgaaggaacattgtaactgttgtaatatagttagttgattaagagatcatctgtagatttcctttcattcttaaattattaaattctgattgtcatgtgcaagaatttcagagccgtattctgaacttttgccataattaaaggaagtttacgtgagaagaaataaagatgtggattaatgatgataaggacaccctaagagttagtgagaaaaaaattactcaaattgtcattaatctagagctatccagagaaatgttggaaggttccaaaattaacctgcattcagctattgattttataataagttgaattttctaaatctggcagtcattctaccactgctaatgtaatgcatgtgtgttaatagtaaatgattttctttagcctaaagtagggaaagtgaacagttagtatttgggagcaaagacagtcttcagctactgctgtgacaaatgtgattaaaattaaccatgaatattctgatgctacagctgaggatataccttttcattgtagttgtagtgcagtggcaggttgcatatataaattgtttccagtccataagtgaatttactttacagtgaatccttttttttctttttttttgagatggtgtgagacagtgttttgctcttgttgcccaggctggagtgcagtggcacgatctcggctcaccacaacctctgcctcctgggttcaagcgattcttctgccttaggctcctgagtagctgggattacaggcgcccatcaccatgccaggctaattttgtatttttagtagagatggggtttctccatgttggtcaggctggtcttgaactgctgacctcaggtgatctgcccaccttggcctccccaaagtgcttggattacaggtgtgagccactgagcccggccagtgaattcctttttaaaacatgagagtaccattaattggtttcactataaatgcagtagagattttaaaaatttctgtagtacttttctagagcaaagattagtgttaaatcactaatactctgtaatattgatgaatatactgtaatatatggaacttggcatacaatagtgtgtattgaccagtgttgatttattcatgtattacttgtcagattttataatgatattttattatattttcttttctatttttattttttgagacggtcttattctgttacccaggctggagtgagtggtgtgatctcagctcacttcaacttctgcctcccaggcgaagtgaacctcccatctcagcctcccgagtagctgggactacaggctcatgccaccacacctagctaactttttgtatttttagtaaagctagggtttcaccatgttgccccggctggtcttgaactcctgggctcaagtgatcctcctgcctcagcctcccacagtgctgggattacatacgagagccaccacacccagcctgattgtacttttcaggaatatgggtgacttaaatgactaaacttttactttaagtcaggtgtcagcaaaccctttctataaagggccagataataaataatttagactttataggccttacctgtctgtcacaactttgctgttgtagtacttcaatcaaactctttacagaatcaggtggcccaccagatttggctggtggctgtagttttctgaccactgttctattgatatatattagtactatatatacagtgttaaagtgaagatgtcttggaataattagtaaaggaacatccagtgatttagaaaaccttacagtctatcattattttgttctgaacaaagctcaattgttataattttctagtatttgtgaaataaatgacacgttcatattcaaagtaggaaactagttttttctttcttctttctcacaggataggtattctggagaaaatggagacaattttaacaggactccagcttcatcatcaggtatgtgttatgggaaaaaggtaaaaccctttttagtttaagggtttcatctagtgaatgaagagcagcagactagtagacatcttgtagagggtgttttaaaaaatttcttagtgaaagttccttctgatttggatattgtggaatgggggtacttctagttagaggaattgagagagggaaaagaatagactgtattatttgatttaatggattactataaaacatttgcctaacttggaagttgcacattcagcttccaggctgctagggcatcatcatcatcagggttcctgacataagggagtagaatataggactataaggttgtcgaagcaggttacaatggtgatgacctgtcaggataataactgtttaagccaaatctgtcataccatcaggatatcttgagtttctttgggatcagaaaactaatttgggaaaggtcttaggagaacaataaaaacgtgtcaaggtaaaggaacccatatccttcctgttgcgccctcctcccaaccccactctgaacttgttttcactttggttgcccctcccaccatcatttttccccttgggttgtccaactctattttacagagtggatgtagatgggaagatgggtggaagtggtaggactaggctgggaaattgaactcatggcagtagtttttcacattgttgaagtccaaaacaggatgaaatgcaattgttactatattaaaataattttgaccggactctggctcatgcctgtaatcccagcactttgggaagccgaagtaggaagaccatttggggccaggagatcaaatgatcatttgaggtcattcgagaccagcttgggcaacatagttggagtctttgtctacagaaaatttaggctgggtatggtggctcatgcctgtaatcccagcactctgggaggctgaggcaggtgaatcacaaggtcaagagattgagaccatcctgaccaacatggtgaaaccccgtctctactaaaaatacaaaaattagggtgtggtgctgcatgcctgcagtcccagccactcggaaggctgaggcaggagaatcgcttgaacccgggaggtggaggttgcagtaagtcgagattacgccactgtactccagcctggagatggagtgagactctgtctcaaaaaacaaaaacaaaaaaaattaaaaattagctggtcatggtggcctgtgcctgtagtcctaactacttggcaggttgaggattgcttgagcccaggagttcaaggctacagtgaactatgatgatgccactgcacccttgcctgggcaatggagcaaaaccctgtctctaaaaacaaaacaaaaacattaaaaaactatgatgaagtatacataagatttaccattttaatgtgtacagttcagcagcattcagtacagtctcattagtctgtaaccatcatccaccatctacccccagaactttcttgtcttcccaaactggaactctgtactcattgaaaaataactccccatttcctcctctcccctgatcctggcaaccaccatctacttccggtgaatttgagttactataactttactatgagtctctaaatcgagttactactatttttaaggcagactagcataaggaagagggcctggtggtatcaggtagtaattttatcatttttcttataaaaaattagtagatgaggtaaaacattttatggtcaagggagctgcatgctcactgaaacctggcctatggtggaaaacacccatggtgaggtagtttccaaaatgtgaggatagtttgagagtcagtttatcaggttaaagcaaatctaattctcatgagcatcttaagttcagggtaaatatcttgacaaaagttaagtttaaaagagatgactttgctattttcaaaatatgtttatcttttataagcatttaaacacagtggtttaatacagaaatattcagattctcagaagttcttggaatcctgcctgctgaaaccccagcaaagggctaattttgcttctaccatataaactctgtgtgtacttagagtattccagaaagacaaatggataaacgtaatagataccttttaacatgtctatttacatcgattgctgtgtaatcaggagaaacctggttttttgaggtatgaacagaagccaatatttgtaaaggaatgaaagtttaggtctatagtatattaacgcataacactgttttgtattggaattttcaagaaactagactgaaataaccaccaactaaaagctaagtttttttttttagcattagacctatgaatgtttaggctaatgaaatgaaatcattaatgaaaatcactaatgaaaaatattgattgcctgcttaccttcttctagataacaagtactttttgtagttcttcataattttttatttttttatgaaaattttcttattagagaaatataaaccaggacagtgaatgtaagccaagccaatacctaaatatgcttattgttttaaaaaaaaggaaaaagggagaaataaaatatgaaatcttagcccctaaatttagctaccattgatgtctattgactctgattttttagattcctgtgtatattcccacatacatgatcgtatgccactggcataatatattaatacatatgttccttttttataaatacttgtcttgtttttcctttgcttacccatgcttaccttccatgcccttttcatgctcttaaaattgtatttagacatgcgtcttttcattctgtattttatagaaatggaatcgtgttatatcacatcttgcttttatttaatagtcatggaaacccttctaaacaactggtattatctgattatttccaaaattaagcgaaaacaatttcacattacttggctttaaaatgtcaataggaggcaggtgtagtggcttatgcctgtaatccctttgctttgggaggctgaggtgggagaattgcctgaaactgggagttcagaaccagcatgggaaacaaagtaaacaaagtgagacactgtctgtacaaaaaatttttaaaaattagctgggcgtggtgatgtgcacctgtaatcccagctactcaagaggctgaggtaagaggattgcttgagcctagaattttgaggttacagtgagcattgatcacactactgcactccagcagggctgatggagtgaaaccctgtctcttaaaaaaaaattctgctgaaccttgcctgccttgtatttgagggtggatcattaaaatcctggttagaaagtcagctctgtgcagggacgcactgatgggctctaccgtcaagtgattgggccagggctaggctgttttgtttgggagagcaggatcctctagtctctgagatttaagtttttgtaactgtatatgctagttccagcctttccttcctcccactctgtcctcactatattgtacagcttctatgttgcttttgctgatttctttattactcatgtttgatttgaaacaagctgtttgtgggaggaagttttagggattttttgccctccccttccccaaaggagcaattcttttgtatgtgtgtgtcttttttttttttttttcccagaaaactttttgcaagttgttttatttgcaatgccctttgaaaggccacgaaagttaactggattacaaactaggcagaaattgctttacaaaaggagggaaataccaaaatgtcagtttctgtagagaatccacagttcagttttattcagagcaaaaaaaaaaaaaacttttaatcacactagaaaaaactcagcaatagatttggaatctgtactcaaactacacatgcaatgacagtattctgctaatgcagtcgatttgctgttgtatttgtctacttttttatattaataattataaactctaaagcagtgcaactagtatttggaacaatctttacagtgtcaggcacatttcacttttcttcacaccattggttctgtgtacgtgggcttcctccccttcagtaaagtcgttttgatattgaaggtcttgggaatgtccacaggtgttttctccttgatcttattggcagcagtcttgcatgtaacaaacctttgataatagcttgcagctagaataaggtcaaagagagttccttggtgaattttcaggaattcctggtcccaaacaggatttttatctcttcatttttcttctcattattctcaggaggaggaggagggtcatctttatgggggggtgcaccactgaatgaccttttaaaatactgcttcattatttggtagaggactgggtcatcatatccttcaatcattcattcccaaatcttccaacgtgatcttgatagtatagattgtttggcaatttctacattaacctcaaatatttcttcattggaactccataactaattgaaggcaggctagaggctgacatgagccgggcagcatcagcacagaagggaagggtggaggacatgactgctctgtgtatgtttttaaacgtgtgttttctgagcatattttgatgtgtatttttaacttagaattttttttttacttttccccctcatcactgtttaagatatattcctaattgataattgatttccttatttctaatgactgtgtggtatttcatatacttttatcaccaagttttatctactcccattcttcctccatgataggcactgagattacctcctgttcccctctgttaccataggatgggcattcttgtatatgttcatttatgggccagagtgagaattactttggatagtggactcgagtagaattacagggttatggaaaggagtaatgtacttaatttgtctaaatatttcaaaaattgctctccagaatagctataccagtttatactcccatcattaggatgtgagggttctcatagtccctatattcccaccaacatttgacatttttaattttaattaattttagccagtctatttgggtataaagtaaaatcttttttttgttgttgttttttgagacagggccttgctctgttgtccaggctggagtgcagtgctgcagtcatagctcactgcagcttcaatctcccaggctcaagcaatcctcctgcctcagcctcctgggtagctgggactacagacttgcaccaccatgtctggctgatttttaaaatttttagcagagatgaggtattgctatgttgcccaggctggtcttgaactcctgagctcaagtgatcctcctgccttggcctcccaaagtgctgggattataggcgtgagccaccatgcccagcatcattgctttactatgcatgtatctgactgtctcttcatatacatgttgttattctgtaagtttctacttttgtaagttgcctgtttgtatttttagtctatttgtctattgagctagcttttcctattgttgattggcaggcattgttaatattctagattttaggctctttcctgatttagacactgaatatcttcttccattctgttgtctgtcagctttgttcatggtatgccttattaatcaaaaatttaattctgaagttattaaataatttttttgcttcttgatttgattttgtagtttaagaaattcttcaccatctctgtcaaaaagtagcctcctacattatcttccttagacttttgcctttcacattgagcttttaatcgtctgaactcatcctttttgaatcatggtggccatatttatttgagtgtcaaatcaagacatagtgtatgcagtatgaatatacctaaatgactcacaaaaaaggaatctttgacgctaaagtttttctggtcagccctgaccattggtctctagttattgaggagttttgtttgtgaactgtggtaaactagacataatagaaaatttactgtcttaaccatttttattttatttatttattaatttttttcttttctattttttattattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtgtgatattccccttcctctgtccatgtgatctcattgttcagttcccacctatgagtgagaatatgcggtgtttggttttttgttcttgagatagtttactgagaatgatgatttccaatttcatccatgtccctacaaaggagatgaactcatcattttttatggctgcatagtattccatggtgtatatgtgccacattttcttaatccagtctatcattgttggacatttgggttggttccaagtctttgctgtcgtgagtaatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgacttttgaatgattgccattctaactggtgtgagatggtatctcattgtggttttgatttgcatttctctgatggccagtgatggtgagcattttttcatgtggtttttggctgcataaatgtcttcttttgagaagtgtctgttcatgtcctttgcccactttttgatgggattgtttgtttttttcttgtaaatttgtttgagttcattgtagattctggatattagccctttatcagatgagtaggttgcgaaaattttctcccattctgtaggttgcctgttcactctgatggtagtttcttttgctgtgcagaagctctttagtttaattagatcccatttgtcaattttgtcttttgttgccattgccctatgaagtccttgcccatgcctatgtcctgaatggtaatgcctagattttcttctagggtttttatggtttctggtctaacgtttaagtctttaatccatcttgaattgatttttgtgtaaggtgtaaggaagggatccagtttcagctttctacatatggctagccagtgttcccagcaccatttattaaatagggaatcctttccccattgcttgtttttctcaggtttgtcaaagatcagatagttgtagatatgctgcgttatttctgagggctctgttctgttccattggtctatatctctgttttggtaccagcaccatgctgttttggttactgtggccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgttgtctgcaaacagggacaatttgacttcctcttttcctaattgaataccctttatttccttctcctgcctaattgccctggccagaacttccaacactatgttgaataggagtggtgagagaaggcatccctgtcttgtgcctgttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagctttgcatcccagggatgaagcccacttgatcatggtggataagctttttgatgtgctgctggattcggtttgccagtattttattgaggatttttgcatcaatgttcatcaaggatattggtctaaaattatctttttttgttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatactgttattggtctattcagagattcaacttcttcctggtttagtcttgggagagtgtatgtgtcaaggaatttatccatttcttctagattttctagtttatttgcatagaggtgtttgtagtattctctgatggtagtaaccatttttaaatgtaccgttgaatccctttttttcaatatggtgagaaatagggatccaattttatttctgtccctataacaacctagttttttccagcaccatctaagcattctgtcttttccttgttgatgtgtgatgcaaatttcatttcttaaacgattttgttctttgttgtcttaaagcattggataaaatctacagttcattgacgagtagtagaaataacaaacatctaggcttttcctcacttcaatgggaatgctcccaaatttttataattatgatgtttgcattaggctactaatagttattttttaaaatcatgccaagagagtttcttttcatttctacttgaatatttgttttgttcaggaatggcagttgaatgttatcaaatggctttttagaattactgatttctattatttctcccttatatctattaatgtagtaaatgaatttttaaatgaactttgtgttcctgggctaagccttacgtgactcttttattgtactattggatgaaattagatattttatttagcacttctgaattaatgtaagattggcgtatagttttcttctgtcatgtcgtcctcacttggttttggtttcaagcttttcatgttttccagtaagctccggaacatgaaaattacctgtttttttacaagttgtatagaatttgttcataaaactgtctaggccagggcagattctttttttttttaaactttattgaagcataatgtacacatagattcaatatgtatttcagtaagatacacagcataaatgtacagctcacttaattatcagaagctgaacactccctgaaagccagcactcagatcaagaaaaacagcattattaacagcacccttgaagccttcctttttcttccaggcaccgtccctctgtccagaagtgactattatcctgatttctaacagcatagatcagttttccctataaatggcagtcatataaaatggcgtcatacattgtgttctttttttgttgaggttttctccaggttgttagaagtagttataggttatttgtggatgtatgatattccctatgtaaatataccgtaaattaaaatattgatggtcatttttatagtttccagtatttgcctgttatgagtggttctcttaagaatgttttccaattcatgtctttcggtggatataaaaatcttctctgaatgtgattggcagaacagtagcattggcatcacctgggaacttgttagaaatgaagaatctcatactgcacccagaactactgcatcagaatgtgtgttttaatgagatcaccaggtaatttgtatgcacattactgttacactctgaagtctctatttggaagacttgacactgaattctaagtgttagtgtttcagctacttggggtaatgaaagggattagaagtcaggagagctggcagccctaagcaccactaaatagtttcaaaactctttgcccctaagtcttttctcatcttcctttaattttcctcactctggtttaggcaaatcactgtggagaaaggttggaagattatagagtcttagagcgcatactgaagtctcatacataattgggttcttttgcttggtggttttagtatatggaattttttttaagttcttgttcaatatttgagcctctttggatttggtccaagtgtaactatattgagagatattctttgtggtcagttgttggggattgtgtacactaacactaaattcattttaaatggacttcatttttatttcttttggtttattttggtggatttcatagcattcaagaagagcatctatactccatcatttattggtattagagtcttatttatttttattgctatgtataatatgtattgtggggattgccgtgatatatatcaatgacagcatatcattacattcatgaaagtgaatgtaaactttcacatttacatgtgaaagtactgtgagatttaaaactactaaaaaatggaaaggaaataattgtatattttccttaggattgtgtgctaataacaaggtaaactgggttaattctttcttagaaccttctactcttgtaccatcatttttatgtattttttatttacataggtttttggggaacaggtggtgtttgcttacatgagtaagttctttagtggagattcgtgagattttgtgaacccattacctgagcagtatgcactgtacccaatttgtagtcttttatccctcacccctcatcgcactcctttccccaagtccccaaagtccattgtatcattcttatgcctttgcatcctcatagcttagctcctgcttatgagtgagaatatctgctatttggttttccattcctgagttaattcactaagaataatggtctccaattccatccaggttgctgcaaatgccattatttcatttctttttctggctgaatagtattccatggtgtatatatacaccactcattgattgatgggcatttgggctggttccatatttttgaaattgcgaattgtgctgctataaacatgcgtttgcaagtatcttttcatataatgacttcttttccaactagtgagaggtaggattcccaagaataattgttaccctgtgactttattgtagaatctttattgaagaccttttcatgaaaaaaatctactgtattgaagtcttatgtaaaccataaagcttaatgttttgaaccaccactaattttaagaacattacccaccgggcgcggtggctcacgcctgtagtcccagcactatgggaggctgaggtgggtggattacttaaggccaggagttcgagacctgcttggccaatgtggtgaaaccctgtctctacaaaaaaataaaaaaattagctggatattgtggtacacgcctctagtccgagctactcaggaggctgaggcaggagaattgcttgaacctgggggtcagaggtcgcagtgagcggaaattgtgccactgcactccaacctgggtgacagagcaagactccatctcaaacaagacaaaacaaaaaaattctcatgcacatttgggttgtttccttttttgctgttatgaacaaactctcatcattccttagtttgctaagtatatgttaagtcatgaaaggtgttaaattatgtaatatactttatctggagagattagttattttttattaatgttgtgtgttacctttttttagatatggtagtgttaaatacccttgcatactgggataaacccaattagtcataatatattttatccattcagtttactgttgggtttggtttgctaatatttgtttttgagattttgtatctatgagtaaggtttataattttcttctgaactttcatatcaaggttatgttggtctgtagaatgagttggtgagtaatttctctgtttcctggaagagttgtatgacagttgaattatttgtcctttgagagtttggtagaactcacctgtaaaacccgatctctctgcatctttctgatgcagaaaattaagtactgatttaacttctgtaggagagttgggttttttattgattcttgagtcacttctggtgagtcaattttctaggaactttttcatttcttttaatttactagcataaagttgttcagagaagttctctagttgtctttctgttctttgagattctttttaaacacatttctaatactgttcacttgtgtctttgtatctgttctcccttcacccccattattagtcctctagtagttggttaccctggcaaattttataggtcttttcgaagaaccaagttttggcctttttgagctgctgtattacgtttgtttccttaaaaaaaaaaaaaaaaaaaaaaaaaaaaaagaggcagacagacaaggtctctttctgtttcccaggctggagtgcagtggtttaataataactcactgcagccttgaattcctgggctcaagtgatcctcctgccttaacctcctaaatagctgggtctacaggtgtgcaccaccacacccagctacttaaattttttttttggtagagatactgtcttgctatgttgcccaggctggtctcaaatttctgacctcaagcatctcttcccactttggtctcccaaagctgtttcctattttattaattttcgttctttatttcctttacttttgtgtgatttactttgtttttctaatattcttgttgagatggctattaagcttattgagttcttattttctagtataaatatttaaatactgataaagtcacatttttatcatataatttgaagtatttttaaacttccattgtgagttttttttttgagctgtgggttatatagaaatgtttttaaaaatacgtcaccaaatgggattttaaacaatttttttcatatttaatagcttttgatttgattgcattgtgataagagaatctcatgtatatgaattgattattgaactcttgttgaatttgcattatggcccttctacatggccagtttataaacactctccattgttgaagaatgtgagctctttaatgttgaatgctgtatatttctttggaatccttgtgcatactattgtatggatgaccataatttctttattccactttgatcatttatttggtattacagacagtgcttataaaaatttttttatgtctgtctggataaccatgtgattatatccagaggagaaattcatgttactgtactttcagagtatatgccttttaaattaggatcaagattgatctagtttataatctaaatacagtgtatgtttcgtgcctgtttccctgtgtccttgttctggctattagcaaatttaagactgttttccattttttaaaaatttatttattttgttattttctttcagggaatagaagggacttttccattcaattatgaggttaaaaattgctgtcttttgatttctagttctttatgaatcagatttagtcacaatttatttttctttaggagaactgtctattcatgtagccatttttttttttttttactgggctgtttgtcaccttttttactgctatataaaatttctcctttgccacatgtggcacagaaggcttaaggtttgcaagtactagatacttgtttttatttgacttacttcaaaatgttgtttgctttagaaatggatgatggaccttctcgaagagatcatttcatgaaaagtggatttgcctctgggcggaattttggaaacagaggtaagcatctttgtctttccttaatctcctgaactgttgaataattggatatatagaggctttcatggccatttggtacaaagctaagtctgttgtaagtcagtgtgtagtagacttggtgttgagataatgagttcatcatttttccaagttcattttcttttttctgttttacttctttgggatagtagggagtagtgttaagttgattagacagattggttggagggatggatgggttggatggatggatgattcacagagctgctgcttaatgtgtttgtgatattgatttccaacaattgatgtgggaagaatatttgtaaaagcttcagggattagaggtgagagggactctttcttgaattttatatttttcaagaaaaggcagtataggaaacatttgttagctcattagtattaattttttaagagtttattttgccattattggatttttaaattttacttttagaacaaccacctgatatgacagataatgacacagcaaaacacctttctacagtccatttttagacttaatattaacatgctagaaatatgtgctatattttattatagtgcaataacatattagaacttcaggttaaatttatttgaaaatccatacggtcatttttttatcttttaggggatgccatagcgagggctatttgttaaacatacttgacacttattcttgaatttatgagatgttattttttgaaaaactctattgagacttgcagatatttttgctgtggaaactaaaagatgcatgatgttttatttgacatttggaaaatttaatttctttagatacaataaacacaaatttgagttttatattttgacatgtttctgccactaatagaaatgatttattcaaatatacacatatatattggtttttaagcctgcatattaagatgcattgtttatttggacaatgtaattgtgctaagagattcagatgagattttgttagctactattaaaattagaaatattttaatattacatttaggagcatatttattatttacgtatcttttaaaattatattttagtagaggttatgtgatattttgatacaggcttctaaatattattgaataaaacctttttcagtgagaaaatcatcactgaggcagattttaccacaaattattttcatgttttaggttgaaatacacataaaatttccgatcagaactctcagttgttaatactttaaacaattagctttatattacctgggacattgtagacccatgagtataacttattttccatatgattcttctaacattttatatagtttccttttttttttctttttcttttttgagacagttttgctcttgttgcctaggctggagtacaatggcacaatctcggcttactgcaaccttcacctcccaggttcaagtgattctcctgcctcagccttccgagtagctgagattacaggtgtgcgccaccacgcccagctaattgttttttattagtagtagagacagggtttcaccatgttggccaggctagtcttgaactcctgacctcaggtgatccacctgcctcggcctcccagtgtgctgggattatagacgtgagccaccacgcctggactgtatagtttcaatcttgattttcttctcagtagaacttgcataactaataatgtggtttttgaagttgactcttcattgcttaaaatatcgactagcttgttatgtcctgtgaagtatgtctgagtagcttggacttcttgaatcacacatctttgaaatctgattaaaatacttttatagttgggcatacacaattttacaggtggtttcaggagttacacagatcccttttaactcccctctacaagggttttacagaggtaagtaagacagtatatagggatcacagggaatgctttaatttttttctcagtgatagtttaaagcatcattttatgctgttttggatgtctctcctgttctttttttaatgttttattttaaataatcgttcttgctatcacatctctgctctcgagatttttaatttagtggtagagaaacacatggaaagaaatactactttaaaaaggtacagatagtatgctgtgggaatgtggaagaaggataaattatgactggagggctaaaggaagacttcacataattggttttttgaagaatgaagtgaattttgataagacaaataagaaagtagggaatgccatgccaaaggaatagcatgtacaaagatacaaaatattagcagttgacagtgtggagtattggagttgtttggtgtgaattaaaatgttgggtgtttagaattacatagtgagaaacaaagctaagaaggttagtatggggaaatagtatggcgagatggggaggccaggaggggagtggtagtcttaggtttttcccttatgtagccccttgttttaattttaaaaatggaaaggatatgataaatataagaaatagaaaaataaaaaatagaacagttaaacaggacacgagtgtaagattttcaatagcagtgactttcacacagggcagagcgtaatagctggctctatcaggatgagaattcaacatatagaaaactatggagcagaattttcctgcttgaaggtctccaatataataccaactagtagaaagctgtgtttcaccggtagtagatttgtttttaccttggtatcataatttaagagtttttcttttaagttgcaggtatattaattaattttaggtttctgtgctactcttttcccatccttggaagtctctttacgccagaaattcatttaattcttagtttttgatgatgacacacttaattttatatgttaaagagtttaactgtccaccctttttcagatgctggtgagtgtaataagcgagataatacatccacaatgggtggttttggagttggaaagagttttggaaacagaggtaattacttggttatgatatcttacaatcaaaacttgagtgattttttaataattgagtttaaatactgattgacagacattccatattgacatttaatttcaaggtatatattctgtgagtgcctttgcactaaagattatcttattaaaacttattaaaaacattttttaattttatgaaagattactgatgaatgcttttaaaattaattctagagacatgtctgtatgcttcagagatgcataactcttagacataggtttttaggaaataagtttgaaagcaaaacttgacgactttttaaaaaagagtaaacaaaaagaagctaacaagattttcatgttattgaggagaaaatcattgagttattgggttataatttagttgtattgtccttagcagatgaagagattgagtttgtaaaattttgagaattttgatggttttaaatagaaaacatatagtggttacactgacatattcctctgttttgcccatgtgcatacagaggagtatatgacaattgaggtaatacagaattggctgaaaagaaagttgtttttaaccttaagagaatggagttgataaactgacacaaagcagaaattgttgtacagcctgagtgaatttgcatgtgatagctatgtatacaattgtgtatcgcttatcttagaaggcatcataactagtagttcctgtgtggttatcatttttaccacagaggtacaggaaattgtttcattttatattttgtataggtttttcaaacagcaggtttgaagatggtgatagctctggtttctggagaggtaaggttgatatttttgtgttttaaaatttaatgtcaagagtacatgctaaaaaagagaaattaagattaagtctcttagtccgggccaattctaacttatttaaaccagattttatgaagtagctatatccaaagccttaaccaaggatattactgctttgtacataaagaattcaggcatcctaatttggcctgttgccatctgccttaatccatgaggtacaacttttgaatgctctgaaacttaagaaaatggggatagataataaaaagaagtagtcaagaagtgaaacttcactctctatataaatacagtttgtgatgtatagggtcacatttagattcaaataaatctaagaaaaagtttcatgagaatgtaaatcagtgctgaaattaaagacaattccattgaaggtactgacactctacaggaatacagagaatgatgagaatgatgaaaataatgataccagaagatggactacgataaaccagtgcattcccaaatctgattgagtcgatttgggtgaggtcttagaacctgtatttaaaagcatccatggtgatcctgatacctcctgtgtttggtaatcattgatgtatgaaatctttataacatagaacactttagggtgccaaacttggcttcatgtctctgccttgctacctgctagttgaagtagaacaagttgcttaatttttctaagccagttttctgttccatagaatggaaggtattcattttataggtggttaggcaggctaagtgagaatgcgtgtaaaagcacacagctgaataccagacacattcatgacaaacactcagatgtcatccatctatcttcattaaatatttgaagctgatcttattaaacactttgattcccaaagtcaaaaccaagcctagacctgatcaccttaaaacacttttggtataaggccggattttaattatcaaatgagactgtttctccaaactattgccagtctctttctccctacttctctttttttctcctatcccgttcaaatgaaaacatatatgatgtagaactagtatttgtgagagaagaaaaataccatcatttttattcttttccatttctatgtgtttctgttctgatctcttttaactcatttaatattcaagatcatttctacttatacacagacctttctacctacttgacccctttgtagagatggtgggccagggagcttttgaatacaaattccagtttctcatggcacttgagagaacttctctccgaagtggcctgcttgctttgttttgatctactttcttcttttttcgtttttagttcccctaaaaaaaaaaaaaaaaaaatatatatatatatatatatatatggattgaattcattcattgtctcagttgttagcaagcccaagttctgagctcacggtagaagctttttactctggacacaaatggatagtatgtttttaaatttttttcccctgtcatctactttgcttaagctggtatattgtagtgataaggaactcagatactggatttgaacacgtaggtgtgagactcagatcctcctcctggcaattgtattatcttgaaaaagcctgtaactttctgcttttcattttctctatttgtataatgatgactatatctacttcacaaggtttttgtgaaactttagactaaagttaatacatgtgatacatttagaacacggccaggtacatactttatgtgttgttattattatttttcgagacggagtctcgcactgtcacctggcctggagtgcagtggtacagtcttggctcactgcaacctctgcgtccagggttcaagtgattctcctgcctcagcctcctgagtagctgggattacaggggcccgccatcacgcccgactaatttttttttttttttttttgtatttttagtagagacggggtttcgtcacgttggccaggctggtctcaaactcctgacctcacgatctgcctgcctcggcctcccacagtgctaggattacaggcatgagccactgcgccaggccatatgttatttttgtataattaataggttgtaactaatcttggtatcattatctcatttttgtttgtgcttagctttatttcctaactgtatagagatcacttattttttaaagtaattttttattttgaaatagttttattcataagaagttgcaaaaatagtacagaggtttttcatgtacccatcacccaacttctcttaatgttttctatttttattcccactgtgatcaaaataactgtaggtttattttagggaaataattggccaaagatattgtgagactctttcccttgccaggtcccagattagtagttttgttttttttttttttttctcgaaagcagtaaatattagttatcatcattgttattccagggccaacttttcaaaacttatttctttcctgcccttctacattgtattaagtcctgccttccagaaagttgtcttgttaatggctcttcaggattgtttgtcagttgtcagctgcagctgaaataggagactgcaacaagagctttgggtcactgtttattgtagaacattattagttgttaaatggattgggactttcacacaggaacttagctaataacctgcaagctgtttggtcacttgctgtcattattttgacttaatgttcccagatattaaatattaatgatatgtacaaagatcccttgaaaccatctttgtattcccaaatgtgactttttttggaatcttctggaaagcctgatgtcatagtaataacatagaacttttacatttcgaaaaatcattcctttcagaataaacatttctgggaatggggtctaggaatttatttttaaccaactctccaggtagttttcaggcagccttcagtatagtaatctctcatactactattttaaaactctgggaatgttacttactaatatcaaaaatggagaagctaggatatccccaaattatttcattagcatgaatgggggaaagtttgcatatatttaagaaagcacaaatgtcttgagtttattaagaatggtaaattggccgggtgtagtggctcacgcctgtaatcccagcactttgggaggccaaggtgggcgaatcacctgaggttcaggaattcaagaccagcctggccaacatggcaaaaccgcatctctcctaaaaatacaaaaattagccaggcatggtggcgcatgcctgtaatcccagctactcggtaggctgaggtggggataatcgcttgaacccgggaggcggaggttgcagtgagcagaggttgtgccagtgcactccagcctgggcaatacagcttgactccatctccaaaaataaagtaaattacagaaaagatatgacattataaatagaagagtctagtggtctatggaccttatgtgagaaccacttgattacttaatagcttagatgttcctgaaatcatttttggtcaaactgaaatttatgaaattcttattttttgttttgttttgctttgcgtagtataatgcttggcaaatagtaggttctcaatttcatataataaacatttaatatttagatacatgagatgatttgtatagggaatcgactctgagtaatgtctttatatatctgttaaaattatttgaagaaatatgtttatattttaacttatgaaaatattttgtcttcttactaatttatcttgtgacagtgctattctttatatattgcatcatttaagttaattaaatgctatttacatgttaaatttttattgaagagtctagtaatgactgcgaagataatccaacacggaacagagggttttccaagagaggcggtaaggaccacattttggaacaatttgtacttaacacagagacactaaactggtaaaactgattttgaaggagctggatgaaaaacactgatcgtgaaaacctttgaagaaaaatactttggtatatgttttctgcttttaatatttgagtgagtattcagtgggtgcccctcctttcactcttttattttatttttttaagtttttggttcaggggttcatgtgtaggtttgttatctaggtaaattgcatgccatggggttttggtgtacagattattttgtcacccagataataagcatagtccctgataggtagttttttgatcctgtacctcctcccactttctaccctaaagtaggccccagtgtctgttgttcccttctttgtgtccatgtgttctcagtgtttagctcccacttataagtgagaacattcagtatttggctttctgttcctgcattagtttgcttagaataatggagctccattcatgttcctgcaaaggactttatgtcattcttttttatggctgcctagtattccatggcgcatatataccacattacctttgtccagtctactgttggtgggcatttaggttgatttctgtgtttttgctattgtgaatagtgctgtggtgaacatatgtgtacatgtgactttatggtagaattatttatattcctttgggtatatacctaattatgggattgctggatcgaatggtagttctgttttacgttctttgagaaatcgccacactgttttccacaatggctgaactaatttacactcccaccagcagtgtataggcattcccttttctctgcaagcttgccagcatctgttattttttgattttttaataataaccattctgactggtgtgagatggtatctcattgtggttttgatttgcatttctctaacgattagtgatgctgagcattttttcatctgcctgttggctgtatattgtcttttgaaacgtgcccatgtccattgtccactttttaacggagttgtttgtttttctgcttgtacatttaatttccttatagattctggatattaggccttcgtcggatgcatagtttgcaaatattttctcccattctgtaggttgtctgtttactctgctgatagtttctttcgttgtgcagaagcttgttcatttaattaggtcccatttgtcaatttttgtttctgttgcggtggcttttggcatcttcatcacagaatcttccagggcctgtgtctagaatggtattttgtaggttatctccagggtttttatagttttaggttttacatgttattctttaatccgtctggagttgatttttgtatgcggtctaaggaaggggtccagtttcaatcttctgcatatggctagccagttatcctagcgccatttattgaataaggaatcctttccttattgcttgttgttgtcaaccctggcaaaaatcagatggttgtaggtgtgtggaattcctatttgcagatggtatgattttatacctagaaaaccctataatctctgccccaaagttccttgatctgataaattacttcagcagaatttcaggatacaaaatcaatgtacaaaaatcagtggcattcctatccactatattgttaaaatggccatactgcccaaagctatttacagatccaatctaccaataacattcttcacagaattagaaaaaaacaattttaaaattcatatggaaccaaaaaagagcatgaataggcaagacaatcccaagcacaaagaacaaagctggaaagcgtcacattacctgagttcaaactatactacaaggctgtaataaccaaaacagcgtggtactggtccaaaaccagatacctagaccagtggaacagaatagagagcacaaaaataatgccttcttttactttttttttttttttgagatggagtctcactctgtcacccaggctggagtgcagtggtgtgatcttggctcactgcaacctccacctcccaggttcaagtgattcttgtgcctttaccctctctagtagctgggactacaggcatgtgccagcatgcctggctaagttttgtatttttagtagagatggagtttcactatgttggccaggctggtctggaactcctgaccctcaggagctgtcacctcagcctcccaaagtgctgggattaccggcatgagccactgtgcctgtccttgttttactttctaatgtcactggatctgttggttgtggtttttttttcccccctatgatctccagaatgtgctatcaattacagaagagggacaatgtgaatcttggtcagttgcaatttagatgaactggggatgtctttgtctctgaatagagtcattggaaatttgaggggggaagaaattgtagattattttttgttcaagtctagctgtatttcaccatactctggtaattcagcttctattgaatttgagatgagattgtatcaaaaattaccatgcttaattcttgattatatatgggcagtcatgttaaaatagcaatgacaacaaaacgtatgaagaatatagtgaacttactataaaattgctgaggatgtgcaaatctatgataagaggttttattgtttggaactacatagtaatcagatacatcagtgtttttaccgcaccttggagacattcttttcctttgcccattaggtaggtagctggctgaattaggccctccctagtgaaggtaggacttgtggatttcataatgagggaagactgtctccttaattacttcttatgataattgtggagaggggtggtggtggggagaaagttaagctaagaaaaaacaagactcatcttttaccatattttttttaacaagcaatttttggcacttaatgttcctaaaacatagctcatatttgaaatttttttcttcagaccagtgaatatcttttgtactattaacatttactttaaatcaatttaattcatatttaaatgaggcagtcgaaaccatttgcagctctatgtgcttggtcctgacttacagattagtgtaggataattagcaggggcacagccattttgcagggtatccctgatttccattctctgtagatgtatacatttgaggataggaagtttgcatataggggtcactcagaaaatacacgtgtgtatatatgtttatattaaaatatgtagacaggtacacataccataagtgtatagttcaattatgtttcacaaactgaactcacttgagttcagtgtgttcaccagcattcaggtcatgaaatacaaattactggcacctcaaaagccccttttcatgttcattttttactcactaatgactcattacccccaaaacttctgttatgacttctaacagcatacgataatttcgtctatttttatacttggtataaatggaatcatatagtatgtagtgttttatgtttaccttcttagtgtgtttgttgcaattgtagatcattattactgtttagtattcttttgttttactgtttttctattagtgataggtatttggattacctccagtttggggccattgtgaaagtgcttctgtaaacattctagtattcttttggttgtcattagtacatactcagaagaagaattgctaggtcataggctatatatatttttggctttaatagtattgtcaaatgttttcagcgtttaaactaagatacactcacattctaaccaatgcttggtattttctttttctctccttttaaccattctgctggttgtgtggtggtgtactcattttgtattaaatttctatttttttggactaatggaatgtggagcacttcttatgtttattggccatttggacatctggacatcttttgtcaagtcgtttgcccatttttctgttgagtatctttacttttacctttttatttgtaaatgatttaaaacttaaaagttgcaagaatagtacatacagataggccggacgcggtggcttatgcctgtaatgccagcactttgggaggcgggcagatcacttaaggtcaggagttcgagaccagcctggccaatatggtgaaaccccgtctgtactaaaaatacaaaaattagctgggcgcatgcctgtagtcccacctactcggcaggctgaggcagaagaatcgcttgaacctgggaggcagaggttgcagtgagctgagattgcgccactgcactccagcctgggcgacagagagagactccgtctaaaacaaaaaaaagtaattgtcattaatctggagtttatttttgtatataatgtgggaatcaatatacattttttttccatatagatgttcagttgacctagtatcacttactgaaaagactgtcccttctgctttgcactacagggctgcctttgtcctaaattaggtggcttatatatgtgtatctgtttctctaggttttattccgttggtcagtttttctatttttgtaccattgccccataatctaattactgtggtttcataataggtcctgatatctggcattgtaagtctttcaagtgcttgtttttcaagtgctatggtttggatgtttgtccttctcatgttgaaatttgattcccagagttggaggtagggtctaatgggaggtatttgggtcatgggggcgcagatctctcatgaatagacctgtttccttgtggggctgttgagtgagttgcctactagttcccttgacagctagttgttaaaagggcctggtaccctctacttcctctgcatcatatgatctctgaacacaccagctccctttcaccttcagccatgggtggaagcagcctgaggctcttcccagatgcccagtcttgaacattttcagatatcaaatcttgagccaaataaaccttttttttcattaattatccagtctcaggtattcctttataacaacacaaaacaaatgaaaaacctcaagattgcctgttatttttagtcctttgcattcctgtgtgatttttagaatgagcttaatcaatttccagaagaaaaagctatcttaatttgcattgctataacaaaatgctataaactgggtagctttgtaaacaacagaaatttatttctcacagttctggagagtcagaagtctgagatcaaggcaccagcagattcagtgtctggtgagggcccatttcctggttcatagatggtgtcttctctctgtgtcctcacatggtggataaggccaggcagctctctggggcttcttttataagaacactaattccattcatgagggctctactgttgtgtggttacatcacatttgtttattcttcagctgatgaatgtttgagttgtttccacttttgggctatcatggctaatgctgccgtattcatttgtgtacaagtttttatgtgaacctgtgttttcatttttctggagtatatacttaggagtggaattgctgtgtcatgtgctaactcttaatgtttaactttttgaggaactgccaaattattttctatagtagctgtaccattttatattaccactctcaatgttatgagggttctgatttctccacatccaccgatactagttattactggtgtttttttaattatagccattctactgagtatgaagtggtatctcattgtgggttttttgtttttttatttttttgagacagggtcttactctcacccaggctggagggctctgtcacaatttcggctcactgcagcctcaacctcctaggctcaaataatccttccacctcagccctctgtgtagctgggactacaggcgtgtactaccatgccctgctaatttttgtatttttttagagatggggttccactacattgcgcaggctgatattgaactcctgagttcaagcaatctgcctgcctcagcctcccaaagtgctgggattacaagcatgtgtgccacagtgcccagcccttattgttgttttgattgcattttttgatgactgtgatgttgagcagcttttcatatgcttattgaccatttgtatatctttggagaaatgtctttcagatccttcactcattttaacaattgggttgtctttttatgttctaagatttatttatatattctcaatgtgagtatcatcagctacctgatttgcaaatgtttatttttttttaatttatctaatttttttttttttgtttttgagacagagtctcgctctgtcacccagactctggggtgcagtggcacagtcatggttcatgacagcttcaacttcctggtctcaagcagtcctcccacctcagcctcctgagtagctgggactataggcatgtgccaccatgcccagctaatttctttattttttgtagggatggggtctcactgtgttgtccaggcttgtctcaaactcctgggctcaagcagttctcccttcttggccttccaaagtgctcggattacaggtgtgagccactgcatctggcctgcaaatgtttaataacctcctgtgggttgtcttttccctttcttgatagtaccctttgaaacactaaaatttaacatttttatcaaacccagtttatctttttatgttcttttggtgttataactagaaaactgttgcctaatccagagtcatgcagactttttcctttgtttccttctaagaattttatagttttagttcttacacttaagtctttgatgcattttgaattcatttttatagatggtgtagggtgggggtccaaattcttttgcatatggatacccagttgttctagcaccatttgttgatgttttatattgatgtgtctagatgtggatctttttgggtttaccctccttggagttgagcttcttggatttatagattaatagttttcatgaaacttgggatattttgagcttttttgtggtaagatctctataacataaaattcccatattaactattcttaagtgtataatttttggcattaagtgcacagtattctgtcatcactatcatcacccagatagaaactttgtattccgttagacaacaattccctgtgtactcccttaaccctggtctttggtaacctctattccatgttctctatgaaatttgtctattttaggtatttcatacaagtggaatcgtacaatatttgtcctgtcgtatttggcttattttacttagcatcttgttttcagtgttcatccatgttgtagcatgcatcaaaactacatttcttttaatggttgaataatataatgtatttaccacattttgtttatccatgtgacggacacttggattgtttcttctttccgactattgtaagtccgctatgaacattcacctacagttatctgtttgagtccctgttttcaaatcttttggttatatacttacaagttgagttgccgggagatggaactaggtaagttaaaatgctgcgaaatttgctgtttaaaagaaaaaattccctgggttgcttcaagccttttattgatttctagagtttggaaaaagttaattctgacagttcttgcccatttttttccttgcctttttggagtagtggaatttagagttccttacttggccatttttgctgatatcagtgatacatatcattttagtgttttcattttattcattagtatgtagaaatataataactatctggtaagtatttttttaaaaagtaataaaagatgttccattttcttttatacaaaggttagaggatttataaggtaatttctttctgaagatattgtcaccaaacatctttaagagttagattgtcagctgtcccttatgaaatgcagactataccttctgggaggactcaggttactttaagaaatatattttgttggccgggcgcagtggctcacacctgtaatcccagcactttgggaggccgaagtgggtggatcacctaaggtcaggagtttgagaccaacctggccaacatgttaaaaccccgtctctactaaaaatacaaaaattaactgggcgtggtggtgcagccctgtagtcccagctacttggagtctgaggcaggagaatcacttgaacccaggaggtggaggttgcagtgagctgagatggcgccactgcactccagcctgggtgaccgaacgagactctgtctcaaaaaacaaaaaacaagaaaaggactcaatttgaatttttagaaacttacagaaaagaacagagtgattaaaggtaaagattaaacacagatgaagagaatgaattaattcaaagataaatctgtggaaattctctaaacttggaaatggaaaacacgagagtggttaataaataaggtatggaagatagactaagacctgtggttcaacatatgactgtctcctgaggagtggccagaaaatgggaggaggacaggaaagaagaatattcaaagagaatagatgagacttttccagagttagagaggcacaagagtcctcagcaaataaaattaaaaaattcatacccttatgcatgtattgaaattatagtattacaaagattttttaaaacctataaaactactagagaaaaaaggtagattcacctttagaagaacattatattcacaacagaattttcttcagtaaaggtagatttcagaatgtaatagcatagtatattcagaatgctgaaggagaatagctctgaatccaaataactatattcagataattaggtgccagggagaaataatgccattcagataaaaatggtgtttaatactctcatattgttgagtaagaactactaaattgtatacagtagtaagacaactgattgcaggaagaaaggcataggaaacaagaagcaatgaggagcgaaaaaaaagatatgtaaaacaggtaaacatattggtaaacttaaataagtattgactatataaactagcaataatgactattaatttaggggttccagaaacaaaagtgaattaaaatactagcaaatgaaaagactgaaattcttgccagctcagttgaaaggaaaaatatttcttaataagtaaaatgaagggtaatcagagaagggataagataaaatgtgtaacttgctgatggaggaaatccaatagaaggacagagctttgtaggaaggaaggtagattgaaaatagtttatttcctaaatattcgtggtgaaaattggtaaaaataaaatacatagctttaccatttggggaaaacaggacagaaaggagaacaaaaagcatcgaaaaaactctgtaaagagaaaacacaaagattgtagaaataaaagacctatgtatcagtaatcataatataggtaagcatatttcaatatggagttgaaagtaaagaggtcaggcatggtggctcatgcttgtaatcctagcattttggcaggccaacatgggagggatctcttgaggccaggaattcaaggccagcctgagcaactaaatcttgtctctacaaaaaaaaattttttttttaaattagaaaataggctatggccataccaccctgaacgtgtccgatctcgtctgatcttggaagctaagcagggttggacctggttagtacttggatgggagactgcctaggaatactaggtgctgtaggtgtcgggggagggcaggtgggggaagagagcattagggaaaagagctaacgcatgctgggcttaatacctaggtgatgggttgacaggtgcagcaaactaccatagcacacgtttacctatgtaacaaacctgcacatcctgcacacgtaccctgaaacttaaaagtaaagagaaaaaagtgttcagtaactcaaagctgaatagaaatagagacaaagtatactgtaaggtagaattattaaggataaattcatcaggaagacattatagttctgaacatggttctaatctaacaatatactaagatgcacaaaggaaaatagacataaggaaaaattcgcaaatcctagtaagttgagacagcagaacagagattaataagaatatagaagatctgaatgccacttactcagcttgatttaatatttgtttggaatcatatactctaaaattataaatcatatatttttccagcatgtatggaaaatatgtacaatttgatcatcttttaaggatgacctatgataaatatatcataggtcatgttctcttattaaaataaaagaaatcaataagtctaaccttcatgatttagaaactgaatttctcagtttatgaataacagttcatatggaaatcctgaaatatttagaatttaataacagtaagaacagagcacatgaaaactttgaggatatagttaaagcagctgcctcttagaggaaattttatagccttaaatgcatcagagaaaggataaaatgtaaaacttgctaatagaggaaatctagtaggacagaactttgtaggaagaagactagattaaaaatagtttaaatatttcttttctcagaaaaaataatgagttaagtgttcaagccaagtagttagaagggagaaaactcaaataaaaaaggtagtagacataaatgaaatagaaacagatacaatagagtgttcagcagtaaaagaaaatgaggtagtttcatatgtcaacaaagttgaataaaaggaaaaagacgtggggccaggcgctgtggctcacgcctgtaatcccagcactttgggaggccaaggtgggcagatcacctgaggtcaggagttccagaccagcctggccaacatggtgaaaccccgtctctactgaaaatacaaaaattagctgggcatgttggttcatgcctgtaatctcagctacttgggaggctgagacaggagaatcgcttggactctggaggcagaggttgcagtgagccgagatgatgccactgcactccaacctgggtgacagagtgagacttcgcctcaaaaaaaaaaaagatgtggaagacgataagttccatttagttcgtaaaactctaacataacactaatatgttgcttaaggctaagtacatagttgataaaattaagagcaaggaaatgaaaaactattcaggatattggcttgttggatgttagttggaaggagtgctcagggagaagagaagcatagggcaaaagaaaaacatgggctgcaaatatgttggaaacattttagtcttaatctgggcagtggagataagctttcattttattatatttttaacttacatatgtgttcttttactttcatgaaaatatacctttacagaaaaggttccagaagatacaatttttttgaagagttttgtttcatttttaaataggttttaaaatacatatactctaatattcagaaatagcatatatagaatttatctttattcatcattctctttaagtataaatagttgcaagtttacaaacggaacagtctttatttcctgcccagttggcactttggttttgcattaatctggttctgccctatgagtctgccctatgagtctgctctatgtgcaattaaattttacttgaactgcttctactaatcttttggtattcaattcaattaaaaattgttcttacctggaaatcagactttatatgtgcctgcatgtctgtgctttgagtaagatgtttactatattctatatggagcagatacaagcctaggatttatttaattcttttgtgcattgtggaaatccagttaatggtgcagttttggtgacttttagtgttttaattcaagtgctactttttcctttaggtgatttttagacttgattctcaaagcaagcagtgaggttttaaaaaattgtagccatatctatttatattagtaaaattgaacacttaataggtcaaaatgtcatttctttttgacaacaatgcctttaaacacttgtttaaagttactgaattattcaaggcttaaattaaatttgaccatgtccccaagatttctttgttgttgttttgtgttgttcttgtgtgtgttttaacattataggctatcgagatggaaataattcagaagcttcagggccatacagaagaggtggaagaggtagtttccgaggttgccgtggaggatttggtctaggaagtccaagttagtactggatttgcaaatgatgtgcttcattaactgttaaaaagaaaatgatttaaaaaaatacgtatcaaagaaggttgttatgaggattatatgagaatagcttagctcagtgactaatacacattaatcaccacattgtatataacattattttttagagagatttgattgcatattggttaagttaaaatatatgaatttaaaaaataagtttgagtgactcagtactttaatattacatactgttcattgttttagagctttgataatatggctgaccttataaacaggtgaccttctatgtggctttacctccccacataccttctttcaccagtgtggctttctaccttaaatttttccagccatcattttttagagataaggtactgacttcagaggtcactgttggaatgtatgtgcctcttaacagaggagaacagatttatggttttggaagctaaaaacataaatttgtaataatgatttaatagatgcgtagcagactagtgaattgtcactttcacagaagtttagggattttgaagggttaccatgcaggactggtaaggtttgatttggcaacagtgggagcaaggggtgctattttgaagaataagtagtgaaatgatgcaatgtgaagtttctcaggcaatttctagagatttaacttgcttgtatcatattttggcatagcactggccctaatttatttaacgaaatattttaaatacattttgaggaagtaatttatcattgaaggacattatttgtagagaattcctttgcacaatacttagtttaacttggtttaatagaatagtttaacttagtttaatagaatagtttaacttagtttaataggacagtatttttctattttaccctgcatcttttaacttctgataccataacttgatttttttctgtttactgaacgattaaaaaacttcttcaaagtaatgtaatctaattttactttctgcaaatcaagataatgacttagacccagacgaatgtatgcagcgcactggtggcctttttggttctagaagaccagtattaagtggcacaggtgagaaatagaacttattactgaatattagttactgatgtatgtttttagcactaggattagtaaacctaatatatatgttaaagtatactagtttggcttatgattttctctgcttttagatctgtaggtaaaaatatgtggacaattttgtctcccttataaaatttgtgcaatgtgaattatttattctgtgttatctaccagttaatttgaggtgtgaattattaactagaggaataaaggattctgagttaggggaaaaggatttgtgtgagttgaagtgaaaatgaaaacacaattgatgaaaaatgttcaaatgaggttaaggttaaagttaaacctagaggccgggcgtggtggctcatgcctgtaatcccagcagtttgggaggctgaggcaggtggatcacttgaggccaggagttcgacaccagcgtggccaacatggcaaaaccctatctctactaaaaatacagaaattagctgggcgtggtggtatgtgcctgtagtcccagctactcagatgcctgaggcatgagaattggttgaacccaggagatggaggttgcagagagccaagatcacgccactgcactccagccttggtgatagagtgagacttgaaaaaaaaaaaaaaaaagttaaatctaaaattaagagatggatgggttaaaggaccaggattcctaagtaataactttgttgaatagaaataacaacatggtttgtgtgcttgagcagcagctgtgttttatctaaatatgttgtgaaacaatgccttacaggtaatggtgatacttctcaaagcagaagtggcagtggaagtgaacgaggtaagttcttattttgtttacccgaaagaagttaaaatcattgtattccaaatttaatttttttctgtacttcactggttggaaacaaatttaatttttgaagttaaaggtaactgttattgcttttatacactgtgaggaccataaatttacacagcctgttttagatagttccttaataccctccaggttattgcctctctgatccagcaattccattataggaattatatactatagatgtatttggaaataaatgtacaaggatgttcactgagatgtcatttataataagtaaaaactgaaaatcacctaaaattcataaataaaaaactgtttaagtccgggtgcggtggctcatgcctgtaattctagcactttcggaggcctaggcaggcagatcagaaggtcaagatgagaccatcccggccaacatagtgaaacccccgtctctactaaaacaaaacttagctgggcatggtggtgtgtgcctgtagtgccagctactcaggaggctaaggcaggagaatcgcttgaatccgggaggcggaggttgcagtaagccgagatcataccactgcactccagcctggtgacagagcgagactgtcaccagttttttgtttgttaaacaaaaaaaaactgtttaataaaataataatcatgaaatgagatgctgtgtggaagttaaagacagatataatatgtacaaatccttattaaaacaatatgctttttcttatggaatagttgatttggtctgaaggataaagttagctcaatatataattttttactcttaaagttttttcttttctttttttttttttttgagacagagtctcactctgtcacccaggttggagtgcagtggtgtgatctcggctcactgcaactatcgcctccagagttcaagccattctcctgcctcagcctccctagcagctggattacaggcacctgccaccacacctggctaatttttgtatttttagtagagatggggtttcacctttgccaggctggtctcaaactcctgacctcaggtgatctgcccacctcagcctcccaaagtgctaggattacaggcatgagccactgcgcctgaccttaaagttttttcaaagtataaatacttcagtgtcatataaaagttaaaatgctctccagactagtaaatcaatgaagcttgctcgatgtatttggaagattctcagtaattattattagtctgagagaattcagagtgacatttcccccacccctgctgattcttggattcttcaatatagaaagagtttattaaagactagctaaaccaaatctcctacaaatattcacagcctatatgaaggaggatttcaagacctgtggacatacaagataagaaaattagagttcacatataaaaaatgttacatctcattagcttttgaatctaatgcagtcatagtacctaaaagtggaacaacagattactcgttatctaaaaaccagaaaggtaatatatagaaaggagttaacaggcctgattgttcatcaaaaattcatcagtaaacgaaattgaaaatcttacttaaaaggctgttccttggctagtgtatattagttagggttctccacaaagacagaccaaaaggaaggagggaggagatggatggatggatggatggatggatggatggatggatggatgaatggatggatgaatggatggatggatgagaaggaactaattaggggaattggctcgtgagattatggagcctgagaaagtcctatgataggctgtctgcaagctaagaaccagggaaaccagtagtattgttcaattcaagtccaaaggaaccagtaaagttttttttttttttttaatactttaagttctaggggacatgtgcacaatgtgcaagtttgttacataggtatacatgtaccatgttggtgtgctgcacccatcaactcatcatttacattaggtatttctcctaatggtatcccttcccctgtcccccaccttccaacaggccctggtatgtgatactcccctcctcgtgtccatgtgttcttattgttcatctcccacttatgagtgagaacatacagtgtttggttttctgtccttgtgatagtttgctgagaatgatggaaccagggaagttgatggtgtaactctcagttcaaggccaaagacctgagaacctcttggtggggcggagtcagggggcgggggattgctggtacaagtcctagagtccaaaggccagagaacctggagttctgatgtccaaggacaagagaagaagggtgtcccagctccagaagagagagaaaatttgcctttcctctgcctttttgttctgtctggcccctagcctattggatggtgcctgcccagattggatgagggtcgatcttcttactctgtccactgatacaaatgccagtctattctaaaacaccttcacagacatacccagaaataatggtttatcagctacctgggtatcccttaatctggtcaaattgacaccgcaaattaaccatcacagctagcatctgaaaacttggatttgggacgggttcccaccatcctgattggtaagagcaactcattgtgtgtaaaccatttgtgcattgtggtttttgctgaatatttgctttccttctgggaatctggaatttggtatgtgccaggcagaaggtgagtacattattagcccctaataaaaaccctgggtactgagtctctaatgagcttctgagtctctaatactcttctctggtagagtttacatgtgttgtcacagctcattgctgggagaactaagcacatcctgtgtgactgcagtagaagacacttggaaactggtgcctggttttctctgggttttgcctatgtgccttttcttctgctgatagtactccctattttttcactaataaatcataaccatgagtatgactatattctgagtctggtgagtcttcctagcaactactgaactgggaatggtcttggggacacccctccaacacaggttcttttagaaaatacattcctttgctgattaggaaagaaatataacagtttaaacaaagtgtagtaatatgtaatagtctcctctacgtaaaatcatcttgaatactacagaaactaaaaatgtacaaggttctatttaattgtttcaagtatttgtaagaagggaatttaaagttttttggaacttgttctctttgaagacaagcaacgaaaataaagatgtgcacagccttacatcttgaccgattgtcacttatgaatttctttaataggtggttacaaaggtttaaatgaagaagtaataacaggctctggaaagagtaagttttccttaaacaaggtgtttgatttttatagtgagagttcttttacctttcaattttaaaaaacatgtatctcttttttatttgatcctcttcaagattcttggaagtcagaagcagaaggaggagaaagtagtgatactcaaggtatattaacatttgtgtgactcacatagaagtatgttgtgttttaataatgcttaagtattttacttaaaaacaaagttatcttttaaaaatttgaacagtgaaaactttaaaggtaagcagtgggaagttccatagtatttaaaatttgatcttgtcaatttttgtctattttctcttatattttcttgtagtctctgtaacgtacattatgtttttaatttaaattccaaggaccaaaagtgacctacataccccctcctccacctgaggatgaggactccatctttgcacattatcagacaggcataaacttcgacaaatacgacactattcttgtggaagtgtctggacatgatgcaccaccagcaattctggtcagtgtattaattgtttctgtattagctatgtagcacactttgcctttaaaatacattatgtagtttgtaaagctgatatcaacacatagatttcacctttcgtatataaggtcttaggttggaaatttagaatgatgtcttaccatctataatagaattaattgctatgtcaaaagagagtaatagatttcatccccactccccataccaggatgagaattttatttaaacttacttaaaaaatgcttttcctagtgattcaagatgttttcccaagattgtgagaaagtgtgtcttagggcagtgatttttctgagagggggagccctctgtctcctattgataattatacttagaacaagccattactgagcagaattcttcatatctcataggttttaagggggcaggaaaaatgtttttaaagccaccatttgtggagaatacttcatgattctgtcaaatcatattataatatacaggctttgaatatttacttctgagtggaggcatgttactaaagtcactttagtatataaagtagaattaacagaacttggaaagtagctcgaatgaaatatgcttataaatgatctgcatatgatatatagaatgtaatcactgcttttttttaaattttcagacttttgaagaagctaatctctgtcagacactgaataacaacattgctaaagctggttatactaagcttactcctgtgcaaaaatacagtattcctatcatacttgcaggacgagatttgatggcttgcgctcaaacagggtctgggaagactgtaagtctttccccacatgtccaaactgttaggttttttgagctttggttcttccttagtaacttggtttcttcttttgagtagaaggtttgtagatggtttcagttacctgtcataagtattgatggttttgcttctgatttttattaggatttgtgtacttcggaagaaagaattctgaactattcctggggtggtgttgctgtccatagatgtttaatcttttctgtgtgcagctctttctgaaacatggtagtatcttaaacaaagtgactgaaagtcaaagcagagcttataaaacagagagggagaaagtaatttctgtattatagctggtacactcgaagtcaaaagattaaagaatgagaaacagttatgcattgtgcatgattccttagtattcagtgacctcaggttatgctaattataaaagaagtctgatgaaaccagttggttttaggactaatctgggagatttgtgtgttaattaacgactccataagatgagactcttatttctatgatcatagagtccatgaggtcataccattttagtcttaatcagccttcatagtagaattgtagggaaaaacaggtattgtatagcagctgatgagagtgttaaacgtggttttggaggtggattttagcaagtgtcttatttgcttaaatgagaaaactgtagcacaaaatttctgttgccagatgtaacttcaataagggtaatgtgttcagtaatacagatgatgatttctaagtttttactctgtgggccacttttgtcatccattctgaatgataattttatgacctcaaaaggactaacttagagtaattgttcactgtaatgatttgcagcgattacatctatcatattcctctataaatatgctaatgttgttgatctgtttagaattcgtgggtatgcttttgaaaatacactgaaaaactttgataggttagattaattttaccaaattttatattgtataataagagcataaagacataaatgttaagaacaccttgaaatgaaagttgttttcatttctcatcttaaatttaccagtaagatggaagtagagtctaaaggctataaggacatgaggattagctttccatagggataaaagtgttgtgctataagtttgtaaactaagcaacttaacttctaggcggcttttctcctaccaattttggctcatatgatgcatgatggaataactgccagtcgttttaaagagttgcaggaaccagagtgtattattgtagcaccaactcgagaattggtcaaccagatttatttggaagccagaaaattttcttttgggtaagtacatcagagtgctactcacaaaatagttttttctttagagatttttttcccctcacttttggaagaactcagtaataatgcactcatgtaatttttagcattacttaaagtatttttttattatcttgtttatggaatccttttcatttttgaaaagaaatatgcttattaaaaattaggttaataggttggacttggtggctcatgactataatcccagtgctttgtgaggcccaggcaggcagactgcttgaggccaggagttcgagaccagccagggtaacatggcaagaccccatctctacaaaaaataaaataactagccagcatgtggtgatgcacacctgttgtcctaggagtttaggaggttgaggcagaaggattgtttgagtccaggagtttgaggctgcagtgaactgtgattgcaccaccacactcagagcgagaccctgtctccaaaaaagtaaaattttaatttaaaaaacagataatactagaagtagaaaatagtgaacatactggtattatttcttggtagtttttaatgtatatttaaaaatgaactcagggtattctaataatttcctattcttttacataaaactttataacacagaaaattcttatttcataataagaactgatttttaatgacttttaaattgcccatgtgtatacattttatttctctgttctgaggtatttaggttctttctaacttggggctattgtaaacaaaattgcaatgtacatcttgctacatagtttttctgttttggccagatatgatgtcttacacctgtaatcctagcactttgggaggccaagatgggcagatagcttgagcccaggagttcaagaccagcctggaaaacatggtgaaaacccatctctacaaaaaagaacaaaaactagctaggtgcagtggtgcacccctgtagtcccagctacttgggagcctgagagattacctgagcctgggaggtcgaggctgcagtgagctgtgattgcgccactgcattccagcctagatgacagtgagaccttgacttatatataaaaaaaaccaacagttttctgttttaagtattttcttagaatagagttttatcaattttaatgttaaagagcaggaacttattttaaagcttgtaattaatgtatatttgtgcctgcagtctatcagaagtccaatttcagtataccctttgccaacatttagttatcgctgcctaacaaactcccttaaaacatagttgctttcaacaataaacatttactgtctcaccattttgggggcttaggaattggggaacagcttggcttagctgggtccttctgagttaagagtttcttatgagattgtaaacgagatgtcaaccaattctggttttattgtcaaccagacaagatgtcaaggcagtcatctgagggcttcattggatctctccatagggatgcatgattaaatggcactggcttcccctagattaagtgatcagtaagaacaaagaggaggctgtaatagcttttatgaaatagtcccagaagtcacacattgtccttctgccacattctctttgtaagaagcaagtcactaagtttgaccccactcaggagtggctatattataatttattggaactagtgcaaaattgaaagtgcagggtcctttgttgtaaaattattacaaatttcaaggcagcgacaacagagcattaaatgaaacacgggattcttctgaacttgggactctgtgtgactggacaggttgcacactcatgaggccagccttacccacactgaagggggaaggtagaatccatatttgaaggaaggaatatattgaagaatttgtatatgtatgttaaaaccaccacaggtgattttattcttttccatgcttgaaatcactttaatatcaaacctgatagatcttttggaaaaacatgtggattgcttatttcagtgtttatatcttgctaatcctcatgtaacatgttgctttcaggcttttaaatcaagtaaaagatctcagaaatcaccactaaataacttatccatgtaacgaaataccacctgttcccccaaaagtattgtaattaaaaaaaaaaatcaagtaaaatatcaccttttttttttttttttttttttttaagatggagactcgctgtgttgcccaggctggagtagagtggtgggatctcggctcactgcaacctctgcctcctgggttcaagcgattctcctgcctcagccacctgagtagctgggattataggcgcatgctaccatgcctggccaattttttgcatttttagtagagactggattttaccatgttggccaggctggtctcaaactcctgacctcaggtgatttgcccgccctggcctcccaaagtgctgggattacaggcgtgagccactgcacccagccagaatttaatatttttttagatagttgaatgtttgtttttttctttttggattttgttttatatcttgttagaaacagatgcctaatttttaagtaactagaaaataacatttagttttcttgttaataggacttgtgtaagagctgttgttatatatgggggaacccagctgggacattcaattcgacaaatagtacaaggctgtaatatattatgtgctactcctggaagactgatggatatcataggcaaagaaaaggtacgccttataggaataatgaagttgtgagattgatactttttgtttggtatgggaaaaggaaagaatgaggtaaagacagatgtatttagtagagcactatttatgtgttagcctccatcacattctttgaatgcattcttatataattctcaagataatcgcagggaatagtgttttctaatttatacttgggaaaacaaactcaatgagattatgtaatttattttaaaaatccctgagttagctctagtaagtatagagctaatgttagaatctgggtctgattccagaatccatattctacatcccactacgctgggggaaaaatgtagttaataactttttatctggtttcatacatgtcttggggaaatagtttttctcctgtaagaaaccctttgtggcatcaataattctgtctcctatgtaagcatgggaatgatattaaccaggattgttaattttctaaatctttaaaaagattttagggccatgtacttatttaggaattcatatactatatttttgtatctctcaatcagtactttcagttcaccttaatgaaccagatttgctttttaaaaactctttaaagggtgcttctgagttaagagtcattttcatccctctgggttactcaaaaaaatgttatttctgcataaacacacctttcttagtatacttattaaaaggacccagagatatctaccttactttcttgctaaacatcttcatagtggtaccaaaatcactttgcaagtgtgttcttctgtttatagtaaaagatgttcatgcaaaggtaagaggttcctgattgttcccgagtgattagagaatggagaatttactaaggatttaaagaggttagaaaaaattttaccagttagaagatatttgaatatgtcatgctgttaggatattttctttcttacattagagtctaactttatcaaatactataatctagatctgtattgtccaatacagtaaccactagccacatgtaacaatttaaatttaagaatgataaaaattcagttccaagtcacagtagccacatttcaagcgcctaatagctagctacctttggctaatgactaacacgttaaacaatgcagataggctgggtgcagtggctcacgcctataatcccagcactttgggaagccgaggcaggcatatcacgaggtcaggagatagagaccatcctggttaacatggtgaaaccccgtctctactaaaaacacacacacacacacacaaaaattagccaggcatgggggcatgtgcctgtagccccagctacttgggaggctgaggcaggagaatcacttgaacccaggaggcagaggttgcagtgagctgagcttgtgccactgcactccagcctgggcaacacagcaagactccttctcaaaaaaaaaaaaaaaaaaaaaaaagcgcagttaatagaacttttaagtaattgcagaaagttttattgcacagtgttgatctagacatttggtttcttttagacttaattttaaaaatgctttataacagaaaattgaactgaaatatacagtaatattatctaagcatatcaattctcattttatacactaatttctagtcttttttcttaacagtattttatttttttttatttttatttttttcttttttttgagacggagtctcgctatgttgcccaggctggagtgcagtggcgcgatcttgctcactgcaagctctgcctcccgggttcacaccgttctcctgcctcagcctcccaggtagctgggactacaggcgtccgccaacacgcctggctaattttttgtatttttttttttttcttaacagtattttaacagttggaattgtagagaatagtttaatataaactaatatgcattttctgttttacctttgaaaatatccttaaagattggtctcaaacagatcaaatacttagttttggatgaagctgatcgcatgttggatatgggttttggtccagaaatgaagaagttaatttcttgcccaggaatgccatcaaaggaacagcgccaaacccttatgttcagtgcaacttttccagaggaaattcaaaggttaagtttttttcttaaaaataatttaattatatatatatacatacttttatcaaagtggaagcactgtgaatatcctatttttagagatttgtcgttaagattttaatataggtagtttaaaaagtagatgtatttctaaaacgtttgccacattttccattgtttcttacctttattcctggctttgtgttaacatcacattttatttaaaaagtgtgtgtgtgtgtgtgtgtgtgtgtgtgtgtttgtgtgtgttgttgttgttgttgcatagaatccagctagggtttaataagtgcttactaaattaagttatttttattattatgccttcttttcaaacctaaatctataggatttgggagaactgaggctttggtagaaaattcatataccaattattggcagatatttgaggatcatgttatataccatggggtctaatgaattcagagattagggtgacacatccctactggaatggtgactctttttcctgccagccccttgtctcaaggagccagaagtgcccaggcaacagcagaagcttatacagatgggtcctatggttcaacataagattttatgatttttttactttataatggtttatcataggtattaattgcatttttgacttaagatattttggacttaaaataggtttatcgggatgttaaccctgttgtaagttgggaaccatctgtaattcagcaggactcttgctattttctctagtggaactgcgttctctttgggaaccaagacgtcaaaacctgtagaacataaagttggaggacaagaagggatgggaagcatagatttccctagtgggtcattgagagtgatggtaggtgggccagtagtgcttgctctcctggattcccagactcatgcaccatatatggatatttgatttgaggaattaccgtgtcatgttggataatgccctgtcttcataaagagttgcctccaaactcacccttgaactgttttttctgcagacagttccaatgttccaatgttctctcaggttggcagcttctgagtggtgcagtatatatattacctgtgaatcctatggttatgggcctgtcccaacacctcttttgctttaaagttggtcccctggtttgatagaatgttacatgggatcctgtgctagtatatcaaacattcccaaacccttgaatagtggtgctggctattgatttattttttatatggtaaatctttgtgtaaagttaggaagagttctttattgggggaaaatagaactcataagacagcattaggtcaattggcaggatatttttctttcttagtggtacataaaacaatcatttcttaacaattgaatagtattttctttctttttttttttttttgtgatgaagtcttgctcttgctcttgtcccccaggctggagtgcaatggcgcgatcttggctcactgcaacctcaatctcccgggttcaagcgattctcctgcctcagcctcccaagtagctgggattacaggcgcctgccaccacgcctggttaatttttttttttttttttgtatttttagtagagacggggtttcaccatgttggccaggctggtcttgaactcctgacctcaggtgatctgcccacctcagcctcccagagtgctgggattacaggcatgagccaccacacccagccctatatagtattttcaggtggaaatggggtatttgcattcccaccatttgctttggtaactatctaattagcagcctgactctttttagattcaccctgaaatgggaaagtatttgtatgttggccacccaaaatggcaaacgtactattgtcagtcagtaatatttgtcgaggatcttttgtgaatcatatttgattataagctctggggatatatgttaaacaaaataagctcctatctgaccttgagttgtttacattctttgcttcctgactctccctcagttgcttcattttatctgttcttaaatgttaccagttgcccatcattctgtgcgaagtccttttctcaatgtgcatattccctgagttatgatatatccgttcccttggcttctacttatacctgtaactctcccaaatttcttccctgtattcctaatctctctctgtagccccagaccttttttttttttttttcttgagacagagtttcgctcttgttgcccaggctagagtacaatggcacgatctcggctcaccgcaacctccgcctccagggttcaagcgactctcctccctcagcctcctgagtggctgggattacaggcatgtaccaccacgtccggctaattttgtatttttagtagagatggggtttctccatgctggtcaggctggtcttgaactcctgacctcagctgatccgtccgcctcagcctcccagagtgctgggattgtaagcgtgagccaccgcacccggcccagacttttaaatttaacttcttggggtgtttgttctcccagatgaatgactagtaactcacgttcatgtccaaaatagaacgtaatttttcttcagttccctttttcccgttttctttattctggttattggcatcatgatcttttaaagccagaattgtttgaatcgtggtgattcttctctcacagtcttttaactccgcttttaaaaatactgaacttgggccaggcgcagtagctcatgcctataatcccaacactttgggaggctaaagagggagaagcatttgagcctagaagttcaggcccagcctgggcaacatagtgagaccctgtctctataaaaaacatttaaaaaattagctgggtgtggtgacacgcacctgtaggttcagctactcaggaggctaaagtgggaggatctcttgagcccaggaagttgaggctgcagtgagccatgattgtgtgcccctgtactctggcctgggcaacagactaagaccctgtctcagtacaacgtggcagtgatattagggttctccagaaggacagaaccaataatatatatgtagatataaaaggaagtttattagggaaaattggctcacacaatcacaaggtgaagtcccatgataggctgtctgcaagctggagaagagagaagccagtagtggctcagtccaagtctgaaagcctcaaaaccaaggaagctgatagattcccccaagaagctgctggtgcaagtcccagagtccaaagtccaaagaacctggagtatgatgtccaagggtagtaggagcagaagcaagcatccaacatgggaagaagaaagagagccagaagagtcagcaggcaaagttatcccaccttcttctgcctgcgttcttgtagctgcgctggtagccaactggatggtgtccacccacattgagggtgggccttcttctcccagtctaccaactgaaatgtcagtctcctctggtagcaccctcagagacacatccagaaacaatgtttcactggccatctaggcatccctcaatataatcaagttgacaccaaatattaaccattacggtagtaatctctaaaatatttcacatctgttagcttctctatttcccaccttaatttaggtccttatcaattttgccctgctcactggaagtggctttttaacctgtctccctgcttctagtgtcacttctgcattagtggcaatgccaaaataaagtctgattcttttaaacatttatttaaaataaaccttcccatatctttccatcttcatagactgatttttaaactctttaacacatgacagtctcaggctcacctgctactttcttacctggagtcgtgtgtttctagtctactagagctatttcctcttggctgagaaagctgaattttactttcctcattatttgtgcttgtttcttctttcctactgcttagaatgcctttccacaatcattagtgttccacattcttgcctgctgcttccctagatcaagcttcaaacttgaagacttttcttttctttttttctttctttcttttttttttttttttttttttttttttttttttggagacaaggtctcactcttctcgcccaggctgaagttcagaggcacaatcatggttcactgccaccttgacctccctggctgaagcgatcctaggcccacctcagcctcctgggtagctggaactacaggcatgcgcatacacacctggctaattttttattttttgtagagatggggtttcaccatgttggccagaatggtctcaaactcctgggctcaggtgatccacatgccttggccttccaaagtgctaggattgtaggcatgagccactgtgccccgcctcaaactggaggatttttctaaatagacatcatttcatccatttcctgccagtgtatcttgtgaaagaaactgtttaagtcactttgcacatttcttggaacatagtgttcagtaaacattaactattctaacactaaactgtaatttttcttaatatatctttcctacttgaagtgaggatctcataggctaacaccatcatgttcatctttgtactcccagtaccttgtacacatgacacaaaacactcagtagttttagtgaatgaaaagggtgatggataatcatctgaagaatttcagatgatttcaagatttgtgcctgggtgagagagtgactctaaaagaaggtataaaaaagcttttcttttatgataagagatcaagtaaggagaaagaagaagcagtgatttattaagagtctggatatgctgaatttgagctgttttcatgaaggactcagctggtaaataagggactgctacataggagggagaggcattgaagagagatttgggcctccccatttatccctaaaaactcatctttctcattagcaactttgtccactcccctatatttctatgtgatctaaagcaagacttctcaattgcagctgatagtgagttaactgtgtgtcaagatattgatacccttaacctttggggcaggcacacctatcctgattccgctatgtccctgggcctttcatctcgtctcacttgttttgcccaattgtgctatgcaaatactactttctatgtgtgtcgtgacagacagagcactgacctaagatctggtttgcttgaaatcattcatttgaagtagagtaatttaataggtaatattttcagaaaacaactaataatagcataaataaaagcaatgagtggagaacagaatttgtgtctcaggcttacatttcaggttttactaaaaaataattcctgcttattgcagtttatttcttttagttcatgcttttttttaagtgttatacacatattttatatagttttgcgtggatagcaaatccacttgtaattaccatatccatactttgacaaactttttttctagtagttatgtattttgcaaaatcctaatattttatactgatctttcacaatagtacttgggtgatataagtaaccaaccatcttatagctgttataatctgctgtctgattaatattgagataacacctacaggaattcagtggatattatggatactgatggagaggaggataagttaaagaataatcttttgtttttcaaggttggctgcagagtttttaaagtcaaattatctgtttgttgctgttggacaagtgggtggagcatgtagagatgttcagcagaccgttctccaagttggccagttctcaaaaagagaaaagctcgttgaaattctgcgaaacataggtatcttacgttgatacatttttttgtcatgattttgattttttttaatgaataatttaaaaaatcactaaagaattgtttggtctgacttttcataagtttgttttaagtctctctccctctaaagctcttttataaaaaattttatgattcagttttctgggtaaattatataaaaatatggtcgtttctccaccattaagtttgaaaataggaaggatttgagacttcattttaactattccaccagaaatgtatctattttttgttttaggaaactagaaaggcttagtagtgacacatatttacatcacactattactccatcaaaagcagattgtttttctgtttctggttcctagctcttgcttcctaaggcttcccaaattcatagatttgaataatttttttagctaaaaggggcttaagatctagttctcttccttcacaatatctgtgggaatttttttttctcctctactcccccaatcaatttttatttttattatctttttagagataaggtctcactttgttgctcggcctgaaataattgtgtagtcatagcttatggcagcctcaaactcctggcctcaagcgatcctcccacctcagcttcccaagtagctgggactataggcatgcgctaccatgcctagctaattctattattttttgtagagataggggtctcactattgaccaggctggccttgaactgttggcctcaatcctcccaccttgtccttccaaagtgctgaggttacagccatgagccactgtactcaccccaattttactttttattatttttaattttttgagacggggccttgctttattgccaaggctggagtgcagtagcatgaccatggctcactgcagcctcaagctcccaggctcaagcagttcttccacgtcagtcccctgagtagccgggactacaggcgtgcaccaccatgcccaaccagttttttagtttttgtagagatggggtttttaccatgttgcccaggctggtcttgaactcctgggctcgagtgatccactcacattggcctcccaaactgctgggattacaggtgtaagccaccattcctggcccaatttttatttttgaagtcattttttttagttcggttgtttagccttattttgagactggaagcaaaaattttaaatatgttcattttaataccttctcattacctcataggctaggtctacttacatgttacactttctccatccacaccctccattttagtacttgcgtttcagcttgaatgtcagtgttgagagagaaatgcgaaggtggttcatcagctaatttccaataatgagcaaaaagaaaaaatggaaaggtgacttaaaaagcacttacaggcttctggtctttaatttgtcctaagttttataaaaacttttaaaaaccaaatactcatcttgagtttgagaaattttattggttggcttcatcaaatgtttcataatatacactaatagcatataaaaataataatagctatgggccacatactgttctaattattggacatgtgttagctcatttaattcccaaaacaaccttatgaagtagattttgtcattatccccattttagggatgaagaaacaaatatagagaggtcaaataacttgtccaccataaattgatgctgctaatgccgaagagatgagcactatatggttttgctgaagttagaacatatttctaatatagtcaccttaagtttttttttttttttttgagatggagtcttgctctgtcacccaggctggagtacagtggcacaatctcggctcactgcaacctctgcctcccgggttcacgccattctcctgcctcagcctcctgagtagctgggactagaggcacgtgccaccatacccggctaatttttttgtatttttagtaaagacagggtttcaccgtgttagccaggatggtcttgatctcctgaccttgtgatctgcctgcctcggcctcccaaagtgctgggattacaggcatgagccactgtgcccggccaagattttttttatatatgagcttgtgggataaagtttattttgcaagtaatccaaaaggagagagtttttcagaagagctggtttgcccttgagaaaaggtcaatgtattatatatgagcactattgatatacttctgtattatttaagctgtgaaatattttttttggtttagtgttcatagttgatacctttttaactttgcatgtaatatccatccagtatatcctcaaattatataaattttgttcatatgatttatctccttttctactctttcacttaattatgctatttttttccttttgcctttaaatatataagtttatttcggagtggcatagcccaactgcctttttcataattttaattttaagtcaacagagatcaaagagtttattgagctctttagttacgaaaggaaccagtaagatgttacagctagtcaaaaggagaattaaaaaaatacatgtatatttaggccaagcttgtccaacccacagctcacaggccacatgcatccctttgatgtggatagctttgaatgtggctcaacgcaaattcgtaacctttcttaaaacatgatggggtgttttttttttttttttttgcgattaaaaaaacatttttttaaagctcatcagctatcagtagtgttacggtattttatgtgtggcccaagacaattctcctaatgtggcccaaggaagccaaaagattggacacccctggtttaggcaattaggaatgctaaaattaatttagaggtagatgtaaaactggtcattattcaaatgcaataatcacatttcaggggaaaactttatttgcatttttactgagaatcattggcattgctatccattgcaacagttatgaaaaagaatatagaaggcacaaagagtgtgctagacagtaatcttttttgcttacttcaaattcttccataattttttctgacagcctgtgtctacctcatgaccataataatctcagagatagtcttgatgacaagaagtttggtcttatgtttggcttgcttattggcatgggtgcagcaagattgttcattaacaataaatgggcctccttaagtttgctgaacagtattgacttactaaagtcacaaaattaacttttgtctggaagttttcataaggaatgtcagattgaactttaaaaatcctttattatttgctatctaagggataggaaactaagtctcagaaactctctctactaggtttcacctgcagtacctataaattggagtgaatctcactctacgaaaggtcccccatatttcctgtggttcctgtcctgtcaggaagtgtatgaccttccttaaaatctccaaggctgggccatgtaagccaagcaccaggtcagcttatatgggaggtctttgtaggcattggttccataaggaaagccaacctttgttccttaaaaaaaagtatctggtcctacctaccattccattttcaaatacgaaatccaggtgagatgttagttggacaggtaacttgtccacttatatcttggttaaaggaggcagacagattcttatttaactgttgcaggtaactaccatgaaaactaaggagacttagttaagaaatctgaatttgggttgggatggggtgtcagtgagatgcgagatcagatatgattttagaatgtttgattttagtttacaaaagcagagtctactaaaatgtgtaaatgacagctagcttaagaggaaaaaagccttcttcatatatccagaaaatagaatattaaaataatattaacagtattgcaaacaaatggccacagagagatattctccataagctcattcagtccttatgtaattcttatttcattgtatatgttagggatcagcttgcatgattctgtctgtttctagaaggactagtcctggaaatctcactcagtccagtgatagggtctaaaagttgtcaaagcagtcaactttagaaccttctacccaagactctattctttgaagtattaatagttcttcacaaggcttggagtctgtcctttaggacatagactctgatctatagcttacagcacagcctttgggcaagcatctaaagaaaacaaaagctgtctgaagatgacagatttaatgatcatggtaaatttgttaccggtaattgttaaatattgagggtctgaggaaggttcatgataagaataatgctactgataaatttttttctatgacatgcaaaataaaggtaataaagccatttaaaaaatactaggcaaaaaatctgattaagcttattttctttctttttttttacagtaaaccctttttttattatatacttttttagggtacatgtgcacaacatgcaggtttgttacgtatgtatacatgtgccatgttggtgtgctgcacccattaactagtcatttacattaggtatatctcctaatgccatccctcccgcctccccccaccccacgacaggccccagtgtgtgatgtcccccttcctgtgtccaagtgttctcattgttcaattcccaccgatgagtgagaacatgtggtgtttgtttttttgtccttgcaatagtttgctgagaatgatggtttccagcttcatccatgtccctacaaaggacatgaactcatcattttttaaggctgcatagtattccatggtgtatatgtgccacatttttattattattatactttaagttttagggtacatgtgcacaatgtgcaggttagttacatatgtatacatgtgccatgctggtgagctgcacccactaactcgtcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggttttttgttcttgtgatagtttacttgagaatgatgatttccaatttcatccatgtccctacaaaggacatgaactcatcattttttatggatgcacagtattccatggtgtatatgtgccacattttcttaatccagtctatcattgttggacatttgggttggttccaagtctttgctattgtgaatagtgcctcaataaacatacgtgtgcatgtgtctttatagcagcatgatttatagtcctttgggtatgtacccagtaatgggatggctgggtcaaatggtatttctagttctagatccctgaggaatcgccacactgacttccacaatgactagtttacagtcccaccaacagtgtaaaagtgttcctatttctccacatcctctccagcacctgttgtttcctgacttttgaatgattgccattctaactggtgtgagatggtatctcattgtggttttgatttgcatttctctgatggccagtgatggtgagcattttttcatgtggtttttggctgcataaatgtcttcttttgagaagtgtctgttcatgtcctttgcccactttttgatgggattgtttgtttttttcttgtaaatttgtttgagttcattgtagattctggatattagccctttgtcagatgagtaggttgcgaaaattttctcccgttttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggtttctggtctaacgtttaagtctttaatccatcttgaattgatttttgtataaggtgtaaagaagggatccagtttcagctttctttttatggctagccagttttcccagcaccatttattaaatagggaatcctttccccattgcttgtttttctcaggtttgtcaaagatcagatagttgtagatatgctgcgttatttctgagggctctgttctgttccattgatctatatctctgttttggtaccagtaccatgctgttttggttactgtggccttgtagtatagtttgaagtcaggtagtgtgatgcctccagctttgttcttttggcttaggattgacttggcgatgcgggctcttttttggttccatatgaactttaaagttggtttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttcgttgagcagtgatttgtagttctccttgaagaggtccttcacatcccttgtaagatggattcctaggtattttattttctttgaagcaattgtgaatgggagttcactcatgatttggctctctgtttgtctgttattggtgtataagaatgcttgtgatttttgtacattgattttgtatcctgagactttgctgaagttgcctatcagcttaaggagattttgggctgagacgatggggttttctagatatacagtcatgtcatctgcaaacagagacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagagttgttgaattttgtcaaaggccttttctgcatctgttgagatgatcatgtggtttttgtctttggctctgtttctatgctggattacatttattgatttgcatacattgaaccagccttgcatcccagggatgaagcccacttgatcatggtggataagcttcttgatgtgctgctggattcggtttgccagtattttcttgaggatttttgcatcaatgttcatcagggatattggtctaaaattctctttttttgttgtatctctgcccggctttggtatcaggaagatgctggcctcataaaatgagttagggaggattccctctttttctattgattggaatagtttcagaaggaatggtaccagctcctccttgtacctctggtagaattcagctgtgaatccatctggtcctggactttttttggttggtaagctattaattattacctcaatttcagagcctgttattcgtctattcagagattcaacttcttcctgatttagttttgggagggtgtatgtgtccatgaatttatccatttcttctagattttctagtttatttgcgtagaggtgtttgtagcattctctgatggtagtttgtatttctgtgggattggtggtgatatcccctttatcattttttatgcatctatttgattcttctctcttttcttctttattagtcttgctagcagtctgtcaattttgttgatcttttcaaaaaaccagctcctggattcattgattttttgaagggttttttttgtctcttatttccttcagttctgctctgatcttagttatttcttgccatctgctagcttttgaatgtgtttgctcttgcttctctagttcttttaattgtgatattagggtgtcagttttagatctttcctgctttctcttgtgggcatttagtgctgtaaatttccctctacacactgctttgaatgtctcccagaaattctggtatgttgtgtctttgttctcattggtttcaaagaacatctttatttctgccttcattttgttatgtacccagtagtcattcaggagcaggttgttcaggttccatgtagttgagtggttttgagtgagtttcttaatcctgagttctagtttgattgcactgtggtctgagagacagtttgttataatttctgttctttaacatttgctgaggagtgctttacttccaactatgtgatcaattttggaataagtgcggtgtggtgctgagaagactgtatattctgttgatttgggttggagagttctatagatgtctgttaggtccacttggtgcagagctgagttcaattcctggatatccttgttaactttctgtctcgatctgtctaatgttgacagtggggtgttaaagtgtcccattattattgtgtgagagtctaagtctctttgtaggtctctaaggacttgctttatgaatctgggtgctcctgtattgggtgcatatatatttaggatagttagctcttcttgttgtattgatccctttaccattatgtaatggccttctttgtctcttttgttcttttttggtttaaagtctgttttatcagagactaggattgcaacccctgcctttttttgttttccatttgcttggtagatcttcctccatccctttattttgagcctatgtgtggctctgcacatgagctgggtctcctgaatacagcacactgatgggtcttgactctttatccagtttgccagtctttgtcttttaattggagcatttagcccatttacatttaaggttaatattgttatgtgtgaatttgatcctgtcattatgatgttggctggttattttgctcgttagttgatgcagtttcttcctagccttgatggtctttacaatttggcatgtttttgcagtggctggtaccggttattcctttccatgtttattgcttccttcaggagctcttttagggaaggcctggtggtgacaaaatgtctcagcatttgcttgtctgtaaagtattttatttctccttcacttttgaagcttagtttggctggatatgaaattctgggttgcagattcttttctttaagaatgttgaatattggcccccactctcttctgacttgtagagtttctgccgagagatcagctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctctttcctgaatttgaatgttggcctgccttgctagattgaagttctcatggataatatcctgcagagtgttttccaactttcttccattctccctgtcactttcaggtacaccaatcagatgtagatatggtcttttcacatagtcccatatttcttggaggctttgttcgtttctttttattcttttttctcgaaacttctcttcacatttcatttcattcatttcatcttccatcagtgataccctttcttccagttgattgaatcggctactgaggcttgtgcattcatcctgtagttctcatgccttggttttcagctccatcaggtcctttaaggacttctctgcattggttattctagttagccattcgtctaattttttttcaaggtttttaacttctttgccatggctttgtattcctcctttagctctgagtagtttgatcatctgatgccttcttctctcaactcgtcaaagtcattctccgtccagctttgttccattgctggtgaggagctgcgttcctttggacgaggagtggcactctgatttttagagtttccagtatttctgccctgttttttccccatttttgtggttttatctacctttggtctttgatgatggtgacgtacagatggggttttggtgtggatgtcctttatgtttgttagttttccttctaacagtcagcaccctcagctgcaggtctgttggagtttgctggaggtccactccagaccttgtttgcctgggtatcagcagcggaggctgcagaacagcagatattggtgaacagcagatattgctacctgatcgttcctctggaagttttgtctcagaggagtacctggctgtgtgaggtgtcagtctgcccctactgggggtgcctcccagttaggctccttgggggtcagggacccgcttgaggaggcagtctgtcccttctcagatgtctggctgcgtgctgggagaaccactactctcttcaaggctgtcagacagggacatttaagtctgcagaggattctgctgccttttgtttgtctgtgccctgcccccagaggtggagtctacagaggcaggcaggcctccctgagatgcggtgggctccacccagttcgagcttcctggccgctttgtttacctaagcaagcctaggcaatggcaggtgcccctcccctagcttcgctgctgccttgcagtttgatctcagactgctgtgctagcaatgagcgaggctccatgggggtaggaccctttgagccaggtgtgggatataatctcctggtgtgccctttgctaagaccattggaaaagtgcagtattatggtgggagtgacccgattttccaggtgccgtctgtcacccctttctttgactaggaaagggaattccctgaccccttgcgcttcccaggtgaggcgatgcctggccgtgcttcagctcacgctcagtgtgctgcaccaagtgtcctgcacccagtttctgacactccccagtgagatgaacccggcacctcagttggaaatgcagaaatcagccgtcttctgcgtcacttatgctgggagctgtagactggagctgttcctatttggccatcttggctccagccctgattaagcttattttcaaagaagaaacctgatttatgaaaatgagcagatataatttttcatatcaagaatataaagtaaatagatttagcagtataattatgaaatcattgtttttacctctcagacctctttagaggatcttggagactctgggaaagacttactttgtcataaagtgtcagtttgttccagaacattgaaaaagcacaatgaaagacaaaatgggaactgagttcacctgtagatgtagaatagggtccagacatttatatttttacagaatgccatgtgtaagtctgatgtacatccctagtgaagaaccactgaagaagatgttagattcaagttaggaaagaggtaaggttagagacgttttaaaaagtgaaattatgactggcaacactgtactattgcatcaggcagcataccttcaagactttgataaatatagggaaactctatagaattactttatagaattttgagcagtgtttctcctgagggtaaaagtatactttggatggtgagagaacttacaaatcatgagggactcccgtaaagcatacacacacacacacaaaaaatagaggccgagtatcacttatccaaaatacttgagaccagaagtgcttcatattttttttttctttttttggagacggagtttcgctcttgtcgcccaggctagagtgtgactgcgtgatcttggctcactgcagcctctgtctcctgggttcaagcgattctcctccctcagcctccccagtagctgggatttcaggcacctgccatcacgcctggctaatttttgtatttttagtagagatggggtttcaccacattggccaggctggtctagaactcctgacctcaggtgatccgcccgccttggcctcccaaagtgctggaattacaggtatgagccaccatgcctagccatgtttcggattttttttaattaacttttggaatatttgcagtacgtttatcacttgatcatccctaatccaaaactctgaaatgctccagtgagcatttcctttgagcatcatgtcagtactcaaagagtttgggattttggattttcaaattaggaatgctcaacgtgtattaacattttatctattctctttaatcttggaaaagtgtagtcttttctggtttgacaactcttaccatacaactcttaaatagtaatacatctaaaaaaaataatttctagaatcccttcctttataatgaaataataaacctttgtgcttttcctggggctctctctgagaaatctcaaaagttttctgggtgaatttcttcttctaaatttttaatttgatcttaaaaagacaaaaggagttgtcagaggagagttgaatatttgattagtgtaggattcgtgggtatcagaaaaactatttggttatcaatttaattgaagtgacaaaacatttagaagtaaacatagaaagtgacatggttgtaaataaccacagctctttcataaatagggaaccttttctctttagtctttttttcttctttttttcccttctttagtctttttttttttttaaacagacctaataaagtcaacagaatctctgctgtctaggctgattacaaggaaggtaaagaataactttttatccagtgtaatggctctgaggaaaaaaaactctcataagcgaaagcattaaacagtaaattaagaaagtaattccatacaaactgagtgacctttgctagaatattaacaccttttatagcttattttaacccaagtgttttaaatcaaagcagataaaattcagtttccaagttttatctttcattgtgctttttcagttttctggaacaaactgacattttaggacaaaatgtgtctcccccaggttctctaagatcccctaattgggtctgcaaggtaaaaataattttcatgattatactaagaattatttattttaatatgcaaatattgttcaaataaagattatcttggtgttaatttttaatatggtaaatatcaaaacacacaagaaaaactccaggattgtcagtgttttatgagtttaaaggtaacactgaccaaaatgtttgaaagccactaaactactttttttccttgaagcaaaagcaattacagtttttatttctgtcactgttattcctagtgtagttgcaaccacttatgttaattatatcttttaatcatagtaacttctatttcataaaggaaattgggagcagggagatgggaaactgggagatgtcatacacaagcattgtctactgttttcagttacctgaagattttggaaattatcttcaagatgatgtttttcaaaacataaatactgttgaataaatgactaaatttagttgaacacagatttccgttttcatactcttaaacatcatgaaggaataatactagcttatttggctagtaaacctctatacattaggaaaaacaaacccaagtagagtaagtgtattaagctttacactgataatagggagaagatgttttggttttttttaaactaaaggtattagtctcatttaccaaagatttcacttaattatgtaaacttggattcttaaaatgattctgattcttgtaatacgttttttcaaaagtttaatatagtttaaagtatatttttcaaaagtgcaagttcaatttctttactttctgagattttaggaatatttaccttgataacatttctcttttattcatctttataaacaaatttgaatagaattcctttaagagactttgtaatttaatgtgttaatacttccgtaggggccgggcgcggtggttcacgcctgtaatcccagcactttgggaggccgaggcgggcggatcacgaggttaggagattgagaccatcctggctaacacggtgaaaccccgtctctactaaaaatacaaaaaaaaattagctgggtgtggtggcaggtgcctgtagtcccagctactcaggaggctgaggcaggagaatggcgtgaacccgggaggcggaggttgcagtgagccgagattgtgccactgcactccagcaagccgagattgcgccactgcactccagcctgggcaacagagcgagactgcgtctcaaaaaaaaaaaaatgcatttctcagaggcttagacttgtctttcactcttccttaagctcttttcctagatacctgcacagttcactatctttatatctttactaagataccatctaattggggtatctaaagtaggcctgtctaataagcctgtcttaaagtatctaaagtaatcatctctggaccctttatcttgctgattttttcctttttagtactaaatgcgtaatatttatttgcctccccatagtgaaagcaggggcttttatttccgcatttccaacagaaacatgacaggcatctagtaggcactaaatgtttgctgaataaatgaatgaagtgagattacagagaaatggggagagagattatgaacagtaatacatttttatatgctttaaagctataaattatctttcttctccaacattttatagggaaattccctgtgtgggaaaatctccggcccatgcttgaatttctaccggttaaatattttaaggagtaaatattccttaacaagttaagaccctgggataaggttgtcatttaattttttaatatgtaagatattttgggaatgaagggatttgaattagagataatgtttggaacactaattatatagagttaagcagccccaggtcagatgccactattgtaaacacctcaggcaatcatgggagaatgaaagattggattatcttgagaggtagacagcaaaaaacatttatagagcgagggaaatggaggggaggaaaggactgagacaattttatattactaagagttggcaggcagatatgatttacctttccctaaggttctacttcttgtgttggcctgggaggaggaaagagaagctaattttttaaatccctcaactaggaaaacagtcctgtgtctttgacatccattctggaattagagtccctcttatgtaccaggcttggctgtggtgctggtagtaaatacagtggtggacaaagtttcatattcaagcactgcctcctatccctgctttatttttcatttcctgattttgaagtttgaatattaataatttcattgtcttgtaggggatgaaagaactatggtctttgttgaaactaagaaaaaagcagattttattgcaacttttctttgtcaagaaaaaatatcaactacaagtattcatgggtgagtagatgaatataattacctattaggggaatgacttctatttggtatttaagaaacatcagtttatataactaatatgatataatcctaggattgggattcagaattctctcagatctaaactgttattctcctttatatgaggaaaaggataatacccaggagtactaaactattatttttcatcctcattcttagtttttagaactaagtggttgtggtgggtaagataaaggtctgccttactctcaaaataaggagtggaaatttctcaagagatctcacttaaggatctctggccccttatcaaattttcctttgctaaatctaatctttcttagagctttttaaaattggagtgctttaaaatgtcatattaataccgttttatgggcacttcattagtagatcctaaaatatcacgtagtatatagtgttgtgaaattatactttaaaaatatgtttttaagcaagcattctaatcaagtagttgtatattttatgtcaagactataaagcatagagattataataggatttgatttttgtcagacttgagattgtagtctgtctctacatattagctgttactttacctcatttgcaaatggggataatttttgcaactcaaagtattatattgaggattaaataaaatggtagcttggaaggaattagtatagtacctggtatgtaagaagtgaacattaatgttaaatgctgctattcttttttttttttgagaaagtcttgcccagtcatccaggctggagtgcaatggcacgatctcagctcacctctgcttccccggttcaagtgattctcctacttcagcctccctagtagctggaattacaggtgcatgccaccatgcccagctaattttttgtatctttaatagagatggtgtttcatcatgttggccagactggtctcgatctcctcaccttgtgatccacctgcttcagcctcccaaagtgctggggttacaggtgtgagccactgcgcccagccaaatgctgctattcatactattattaaaaagaaatttgtatgttgaactttaatgattcactttaatgattttaagagtggttctaataacatgctttcttttctttcaagtgatcgggaacagagagagcgggagcaagctcttggagattttcgctttggaaagtgcccagttcttgttgctacttcagtagctgccagagggctggatattgaaaatgtgcaacatgttatcaattttgatcttccttctaccattgatgaatatgttcatcgaattgggcgtactggtcgttgtgggaatactggcagagcaatttccttttttgatcttgaatcggataaccatttagcacagcctctagtaaaagtattgacagatgtaagttaaacttttatgatggaatggatagttttcttactttgttgttgaaagtagacattttatgcatgtgtatataacaagtaaacttttccaatatttaatactttatgttgcatatgaagtcaattttttttaaaggctcaacaggatgttcctgcatggttggaagaaattgcctttagtacatacattcctggcttcagtggtagtacaagaggaaacgtgtttgcatcagttgataccagaaaggttagtagaaaggaaaacttgagaacttgtcttctagttactctttgtaaatgttgtgcttaatattgtgaagtaactataatatttaataatcaagccattgttttcgtgcctggaaggtagctactttattatttcattaacattttatgtatatacatatttttggttttaaaggtcaggaattaactttgagatttatgcctaaacagtctcctttcccagattttaaattttaatttggaatcttttaaacttctgatggaattatttaatttttgaattctgacaacattaattaatataaaatacaggacctgttggggttacaagtcttttctttttcttttctttttttttttttttgagatagtgtctggctctgttgtccaggctggagtgcagtggcatgatcttggctcactgcaacctccgcctcccaggttcaaacaattctcatgcctcagcctccagtgtatctgggattacaggcatgtgccaccatcttagctggttttttttttttttttttttgtatttttaatagagacagggtttcaccatgttggccaggctggtctcaaactcctggcctcaagtgatccacctgcttcaacctcccaaagtgctgagattacaggcgtgagccactgcgcccagccacgaggctacaagtcttttctggtatgtcaggtttttataggctgaacaccgcctttattcagaaacaatgagcatgttaattaaatatttatgctgattcattgagtgtagtgcattaagttttccccacttgtcaaaactattgacttaaaaaatatttttcttgaaacattttgtgcaatttagatttcctcatttgacaggagccttttttcaggtgaatcagatttagtgagaataaagttctttgattatttggggaagacatggtagatactttgagtccttgctctcagtctgagtgatgtaactttaaagctgtcataaaattaaatgtttgtttgtttctttttttttttttttaaataattaccagggcaagagcactttgaacacagctgggttttcttcttcacaagctcccaatccagtagatgatgagtcatgggattaaagccaaaacatccttcaagtctgtggttttgatgcagagaagaaaatagttttgatttttgagtttttaacagaagtataaaacttaacattctcatagctcctgtccttgtattctcactcctacacttaaaaaaaaaatccttactgactagttatgtgagatgctaaaacttacaacattgcagttactgatacaaatggtgttaactgggaatattaaagcattctaaatgtctttcttatttctggtatattctttagggggcttagacatgtttaatgtttaaatgccaagtcttactatagtgtttattgatcttataaaacaagcaaataggatatgatacacttttggttaaaaattactgggtctcatttttacttgagtctttaaaacagtagtgtgtcactataatgtgataatctttaagagaaagtagaatacttaagcctttcaaagtgattttgatttttagatcatcagatgtatgatgaaaatggttaaatgtttgtgatgggagctctgtactcaatggcataacaatgtttatttttataatatacaatctttccttgaaataaaggatgaaacacttttcccttaagttttccatcagcactttaaatttttctttgttgcatatcctagcccaaactcctatatttttgaaactgtttttttgtgtcttgcgtaaccagtgcagtgaacaaagtcttacataaattaaatattaatgtataaacattactgcacagatgtggcaatgaaaatcaatcttagaactcaaacccgtttatcaacaaaaaacaatgctgcttactctttccataagtttttgattcatattttaagattgatgaaagaaccctgtctttcttcattttccattatatatcttgaacttactatgcctagaataatgaagttctttttttttttgagacggagtcttgctcttgttgctaaggctggagtgtaatggcgtgatcttggctcactgcaacctctgcctcccgggttcaagcagttctcctgcctcagcctctcccgagtagctgggattacagacacgcgccacaatgcccagctaatttttagtagagacgggtttcactatgttggccagcctggtctcgaactcctgacctcgtgatccgcccgcctccacctctcaaagtgctgggattacacgcgtgagccaccgcacccagcccgaagttattaattaattgttaaatgaacgaacccaaatatttaagacccagtgaggtgtaaatactggggagacaaaaatgattggtattaagtgttactgttcacctaaacaatccaaagtgacatgtccctgatgtatatcttgttataggaatttagttaataaatgaggcatcacatatgaaaaaggaaggcatatcaacagatagtgttagaataactgggtagatgcctacctcatgccatatttaaaattaacttcatgtgaattataaaatattaaagctaatagttaaatattaaccctttgaagggttgactttaagctaaggaacagaaatcaaaaaagaaacaacagatttgatcactcaaggaaagattagttgcctacataaaaaatagtgaaaagtagacaaggaaaaatattactgtgaccacagtggttatcagtgttctttatatgtggatatactaatagaagaatacaaagaacatagaaactcaaaaagggcaccagcatggcacatgtatacatatgtaacaaacctgcatgttgtgcacatgtactctagaacttcgagtataataataaaaagaaaaaatgttgacaacaagaaaaactcaaaaagggaagttcaattaataaaaatatgggacatatttcacttttcttctgttatctcacttctgggaaaggctaaatgaatgaaggtgtttggattgttatttgtaatatctgtatgtcttaattttctagtttcgtttaggaagagtataggccagtcttgtctcatttttttcattgctttttttttttttaacagattgctccctctgaactgattccttttaagcttttgcttgatttgtcagattaccatagtagcattactgaatcaaatataaaaaaggaaaggaaatgtatcatacatctaccaccattacagatgaactgtaaatgtccctatgtttaattactctcctcatttctaggtataggtttgaatcatctctttaaaaattatcaaagtaacatgcataaattagaaaagaaaatgccatagaagcatttataatagaaagcaatatttttctgcccctccccttccaaattgccattccacatccaacaatcagctattattaacaatttctgttcactgccatcatatacaggttgagtatcccttatctgaaatgctcgggaccagaaatgtttcagatatcagatttttttttggattttggaatatttgcataatatataatgagagatcttggagatgggacccaagcctaaacatgaaattcatttgtttcattatacctcatatacaacttgaagataagttttgatattttaagtaattttgtgcatgaaacaaagtttgtgtaccttgagctgtctgaaaactaaggtgtcactatcttagtcacatgtggacaatctgaggcatcacattggtgctcaaggtttcaggtttaggagcatttgggattttgaatttttggattagggatgctcaacctgtatttttatgtcaccaaccagaacgtctgttgactttgatatatgaagatttaactcacatctctgactcgccgtagaagtatacctgtgagatgattttaaaggcaccttttcctttcctctatttgtatgtcataacatctgtaaactgcacatttacatttcccaagttaacatttgcattttctataaccataaagtctcccttatatacacagattccagaattgaaaatcaaaagcatgtgtttatataaatattgttcactggatgggccaattcacacagtcttgattgcctcacctttactatcttcctaattttatgacttttgtgtctgcagggagaatgggaagtgtcagggtcaaatgaaaactgcccaaagccattccacataccagcttgctttgaatttggatcacacaatttttgagcaatttgtttaccctgtttgtagtgtttttttgttttgaaggagacagatcatgcatttttcatattaccttcccaggtttgatgttaattttcttaaaagatcccaaaagatattggttgtcttcacttttatgatgaatgcgacttgtgtgtgatactcagggtgctttgaaaattgttttttttttttttcttggtccctaggagtgttttttgtatttgataatttttttcccaagttttctctgttctctatttttggagcttctattagattccagaactgaattctctattgtatctttcctgtttttttcatcttttatattctagtatatattttttactttcaaccgttttattagcaattgtttttaattctccagagctcgcttgctcactctatatatgtttaaatgttgcttaataatagtgaattttctgctttactagtgctttttaaattcctggaatttaacctaagaaatcatgtcttatgttgatcatttgtttttctgctgcttggtgtcagatatcttaacccttgatcattttataagttgtaggtacacatgcttctcaatttacaatggaattacatcccgataaacccactgtaagttgaagatatcagtaagccaaaaatccattaaatacacctaaacctgctgaacatcatagcttagcctaacctgccttaaacgtgctgacaacacttacattagcctaaagttgggcaaattcgtctataaaaagccgatttcataatgtgttgaatatctcatctcatttattgaatactgaaagtgaaaaactggttgtatatgggcactcaccattaacgtacacagctgaaagcacactgggccaaagaatgtttgaaacatctagaattgctggatgacagggatgccacggtgacagggcaatcaatttctcttctggtgaggctcaagaataagcacttgggcatccacacagaatgctttagcgtttgggtggtttacactcgtggtctcatggctggctaaaagctgtgtctggctgctgctgcccatcatcacagtctccatccaccacatactgctagcctgggaaaagagcaaaattcacagtacgatttctgctgaatgcatatcgcttttacaccatcataaagtcaaaaagtcatgtaagtttaaccactgtaagggtccgttaggtatatttaatgcaactcaagatcaactttcatcagattctgcaagctcttccatttttgtacttttcccctcagcccttagaattgagtgtcctttttctaattatttcaaggtctgctctcaaggcagaggttgagatgtgactgataaggcttaacttttcttctttgaattctttgcattttaataggagtgaaagactgtggccttagctaaaaggaagctcaaaatgtggaatcaccattttgagcaacatatgctacgcaaacaccagctacgtatgtgagagttggggaataatggtgatgtagtggggaaggaacatcaggggatacctgatatcacacaggatgggtaacctacctgttccaccagtccctgggatcttgggggtggagtagatatgtcttttctgatttcactgtttgcacttacaacattttcccctatttatttactagagacagggtcctgctgtgttggccaggctgatctcgaactcctggcctcccaaagtgctggattacaggtacatgccacagtgcctggctttgataacatttttattatataggacggcagcagtggtcagttttcccctcgcaccttccccatagcttcacacttgtgctggtttgcgtagatctctctcattagtgccctaacttgggagcagccattttttcattttgttcggtgtggccttcatcgatttttttagcgtattggaaatagggcggtattttgttttctaaagcattttctaaaaacttcgacttgccagtatgtgcttatgctcactgttggatttagattccccggtccacaccgaagcgcgatcctagtacctccagcgtgaaacagtccagaaaggagtcgtcgatgtcccggggccctggccgggagaacgcctcgcggggcgggctggtgggtggctgtgtgcggggagccgcggcgaagctgcttccgcccgcgtgtcccgagctcgcggaggcgggcttccacgggcggccctgacccggtggtcctgacgctctcccagccagcggcgggaggcttcccaggggcggagcgagaggttggcccggtaggatcgggggactgagccgagagtcaccgcggttcctgccccgggagcccgggctggccacacccaggtgagtggcactgtggggcgcggcgcagctaggctggccccgcgggttttcctcgggctctcactttagaatagcagttctgatctctttggatcacataaattatagaaccaagttttacataaaattgcaggggctttaacctttaacctccttgaaatccattaacagacccacccaagggagccaagaactgcacattgacccctgctctagagacagatggtgccatgagggattccatgccaggaggggacaggggaccaggggttggtgtgtggggacactgatgctggacactgagcaaatgagatttgtcccagttctttgatctttacctaagtgattcattgttttgctgtaatttttaggatgtttatcaaatcatcaaagtagctcatctggaagatacttttctgtgggagatttcttgaaagatttttttgtctccatcagagttttctggatttagagtctcatatttctgtgggattctttttcagaatcaaaaatcttttccctctccttctgaacataggaacttactatcccaccatcttggatattttaacttggttttagttttggaatgaggcttaccgtgtgggagattgaagaattctcaacagaaatcaaagcactttaaaatagttttaaaaattatggatagcaggagaagcttcttctatataacaaagtaagcctgatactagttggagtagccttaacattggctatatttgccgacttgtgtagtacctagtgttatcaatgacctgctttaggctttgatttgcttatgtgtaaaaggaagataataactagatttttttccccacatctccatctgatgaagtcacacagtccatacagttacataaagtatttttaagaggcagccctgtgtaagaaggctcagtatcatagctgaatgctggtgcacttggattttagtgctcaggtcttattctggtattgcattaactgctttgtcgattttagagagttgattcttaagaagtcagtgatcactttgccaactctagtggttgaatctctattacgatacagtttgcccttgggatatcatacagcaagagtgatgcctgttaattgaccattttggcatcttattatatacctcctctagcaattgtttcattaatcttagattgttccattactggagatttattcatgataatccactgatgccaatcagctaagcatacttcccaatgtgttcatgccagttaaatgttgcaatacaagttctggcaatttcatcttaacatgtttgttcttcagctgaggtattttattgggctagcagtcatctggataggtggaaagtttggttccaataatttacttcagttttataaacagaattactgttgctatgatgccacaaagaaaacactatcatttggagtagaatttagaatgtatacgtgccaaaataagttcagtttatcatagtgtgaatactataaaatatgtactgagagtaatgccaatcacttatttaaatagtaacaaacctgtagttttctcatctgtgtatgtaattcactaggaaaatgaaccctactctggtgaaatgactcagattaaccaaagtttgaatcctattactaattgtgtgatcttggggaagttaatttttttaatttgaaataaaacttacctacaataaaatgcacaaatcttaagtttacagcttaaatgtttacctatgtgtgctccttgtaaccatcacctaaatcaagatgtgaaacatttctatcaccctaaacagtttcctcttgcccctttacagtcaactccctggcccagagcactattctgatttttatcaccataaattgggtttgcctgttattgaacgtcatataaatggaatcatagagtatctctcttttgtatatggcttcttttgttcaacataatagctgtgagattcatccatgttgttttgtgtaatagtttctttttattgtatcatgaataactacaaattatttttgtagtctcctattgacaggcatttggattgttttcagattttgaacaaagctcctacaaatattttactacaagtcttttggtcaacacaaggactcatttttctgggcatatactcagaagtggaattgctggaacatagggtataactttttattagaaacagccaaagagttttccagaatggttgtaccatttactatagccaccagcatcataagaatgttctgtttgctccacatcctcaccatcagtatgtgttactgttgtttttaattctagccatttactgtggttttaatttatatttccctgatgattagtgatattgggcaccttttcatatgctcattggcagtttccttctttcttcacctgtttacgtgtctgtccagtcacataaaagggggtggagaaaaggtggtgaagcggtgttgtttgtctgaggtaatgcctgagattcattgtctcatgccaaggaaatcgaagatgcggccatacaaggagtggatttaggagcagaaagtttaataggcaaaagagaaaagagaataactctctctcctgcagagagagagggatgccagagtgggtcttctggtcccatggtgaagtgcacagggttttatagtctggcttgaggaggcagtgtctgatttacatagggcccaaagattggttgaaccaggtgtgatgtttatataacagttgaagaagctggccaccccaatctaatcttttattatgcaaacagattttctacctggctggtgccatgttgtctgctccctactgtacatatggctgacaaagaaaagggaagttggagccaccatgttgaacatgcctagcccctaggtagccttttcctattgtcacagctgccagctttcacccgtgcaagcttctagcttgcttctctatgtctgcggctcaattttacaggctgttttttgttagaaaagaaatgatttgaaggctgctttttattaaaagggaaacctgatcaaggacttccttaccctcactgtctgcctaaataatttttttgaactcctatatcattgggatcaaaggatgaggtgctgtcttgctattcagtggtgataccaagagttgtgaaaatagtttatccttaggctaaattacagtcctttgggttgctcattatatctttagggtgacatttgctgctgttacaaccccaaaacttcagtggcttaacaaaatagaagtatgttttttgcttacctgactgtccaaaaagggtattcctggtaggtaggtgtccttcccagtagttacttaagaatccaggttccttccatcctgtggctctgcagtctggtacagcttccaagatctttatgcttctctttatcaagccagagaaagggaaagagttggagaggagagagacaaagtggacttgtggaacatttttatgggtcaggcaaagaaataagcatatacatctcagattccactgttacaaacttagtcacatgtaactgtaagagagactgggaaatgtggccttatctgtgtgctcagaaagctgggaatcagctagcagtttttgccaatactgttgaaatgggttgttctccaggatggtcaatggatttctgtagtaaattgagtcaggacaagacttcttgatcttcacgtatcaaggaatctgtgtaagctgctaagagttcttaaataagacaccttcccattctctgctttctgcagcatgaaggagagtgaccatggaaatatagataatgataactgaaatccattctgtgatggtacagaatgcttggctgaaagctgttctccattcatgatgattttttaaatctagtatctaatatttataaaataaatgcaatttggaataaagtaatcatatttcatctttcataaataatccagaacttaggattttaaaagtttaaaaaagtgattaagtagttttagtgacttattagaaaatgacttctaagacagtccgtggggaaaagcaaagctgtttctttcacacctttttttccattgggctactaatatactcctatatttgagttgccaagtcattatactgttcttttgtcttaaaatcctctatcaacgagagagaaattactgtaaatcatttaaaccttgggtcagcaatctttctagctcttaagagttcagtacacatcattgttagaggaaggagaggaagaagaaggtaaagggggaacagaaaatgatcatgagttgaggtgcagtagagcttctccaattcctatgtcttgtaataaagtggccttgtgttgtctaagcttttcttggacaaatcattactctagaactgtcctgtaaaaatataatgtgagccatatatgtagtcgatatatcccaaatactgtcatttcaacatgtagtcaaatgtaatgattattgaggtattttacatttatgtactaaatctttgaaacccagtacttattttgcctatgcttacatctcaatttggacactaagttatcattggaaatacttgatctttatttagagtgtatgaaatgtgtagttatagagtagattcacacacccaagttgtccaaacatacttgaaagttttccaacagctgaatcaagtctcaatttttaaatttaaatttagactaagaaacattaaataaaattaaaattcaatttcttattgcattagccatgtttcaagtgctcaatagccacatgtggctagtggctaccacactgacactacaactctagagtctagattgagtttagactgtaagctcaaaaaatgtttgtggattgaaaatattaatgtagttttaaaatgtctaaaatagaattgaaagtagtgcttaataaataagctaatttaattgaatagctggagggaagccagacttccaaagctaaacctttatttcaaaaacttattcctggtaaacatgcgaagtgcagatacttagatcagaatggctatacctttttttggagaatgcctctttctagcccaatggctggcaattctagtcaaattgcatgttaattgccacataacggttagctaaccaattgtggaggaaaattttaagctgtcatttctgtaatccattggtttgcatttgggcattataaagtaaacatgaatgtagtcaaaacaattagggttgagattctgaaaataattatgtcccattccatattccatgtcactctgcagaggaaacaattttattgttataggggcatgcacatctaattttgaaaatctaacctgccaaatatcctgtgtgaagaaagcactctattctttgagaatgtgactcttctaccctaatgcccagacatcttttgtactacccaaattttactagttcaatgctttactcgagtcgaccttctttcacaaagctttccttgattactgtagttcacattgatccctcccttccctgaatttatttctcactcatggtaacaaccaaatattttgtcaaccaaatactatgtatctacaatgctgtgaattgtttcccatttgattattgagtgtcatcacatctagcacatccaactcagtgattgataagtggcagttgcttaacatttgcttgagtacacagaaaacaagaacaccatagaaatcctgggtaataaacataagaatctctgactgttccatgctttgtgctcagattgctttactgcattctcttgtcttgagtagtgtcaggagctcggctcaactggagagagagtgctgaactgccaggtgttgttggaatactggattaaaggacaatcaaaataaaagtgacagtcaagcttttcatcacttattgcaatagtataaacaagagtctaaaccagagaaagcacctgctccattccattcctctcacagcccccatggaatggcccactagttgaaagtcaagtagaccagcacagagagaggagttgtcctcactgtctgagagctccaaacaaaaggcttgggcagttttatgggcccagggcctagcaggaggcagagggaagggctaggagtgcaaaagcactgagtcagggtggagcaaatcatcttcgagttttcccgataaggatacctctaaatggaggcagctgagccaggaatgcagccatgtgtaaggtcatggtggaccaggggactgtaatgacttccagagactgcagtgcactggcagtgccactaagtctgatgtggagagagcagctttcacccgtgaggtctgtcagataaagtgtttgtaattgcctatgatcaggcctgaaaaatcactcaggtttttttttttgccaggaaccaggctcctcaagtaggaaatcacttctattgtcaaggcccaaaactactctcatctattctagaaggcacattttctcacactttaacatctctgaaagcaggatgcattttacaattgatgtcctacaattgtagtgtcaggtaacagtttatgatctagttctatgaaaagcttcttttgacacttgtgtaaagtcaagaaaacactggcatcaaaaagtcttaggtttgatgagatacagtattcttttacatcataaacagtgtctacatcacatctagagtttggcaggttttgtctttggcatctccattttagtccttcctaacatgttccagtgagcttcccaagactatgtaaattctttgtctgccagctgagaagaatacagtttcttttctgttttttctttgaccaaagtctcttgttctgtaaaggtcaacatagtcttaaaaaaaccctatcagatcatatatccttttttttcccttactgatgtttaccttttccagggatttttggaatcttaaatcatgccaagcctttctgggaatagcttgaagaattttgagaaataagtgacatgactaaaaatgaaatttcactcatttggctagctgatgggtctaaagtggaaggagttgggaagacccttcacacatgcaatggatcccctcacttgactctgttgggactgctgtgaactgtcttaagctctgccagggcagaacaaatgaattaaactgtggaatgttctgtgggcttcagcacccaattggaaccattttccccaaatccaactgttaaacctgtttaggattaaggactggggataagattctgatgacattccagtggtgaacatctgcactgttatttgtctttaatgcaatttgggaactaaattcaaatggtagataggaggaggaaaccaaaggatcctcagggaccacataaaaaatgtggcaagcaaaagcccttttatagaaaaaagatttggagaccaaattttgggatagtggtcctgacagccctctctgccaatgactgaacaagaggcttaggcactggactccctgaaatggactctaccttccttcttttgtgtgacccttctttaccttttccatatattctctcttctaacactctccttagccttgggttattctgatgtgcaccccgctcaagaaccactggctagactttagatatagacagcatgtttaggtagatgtatagtaacaccttctgttcattttctgccttcttgaaatttgttttagttacccatcgctgcataataagttaccccaaagctaagtggcagaaaaactacatgtattatctcactctttctgtgcattaggagcctgggcatggcttagctgggtactctggttctaggtctctcacaggatacaatcaaggtgttggctaggatgcacccatctcagggattaactgggaaatgatctgcttccaagctcacttggggttgttagcaaggttcagttcctttgggttgttggactaaaggtctcagtttcttatgagctgttgaccaagggctgccctgagttccttacgataagtgcctctccctagtgcagtttacagcaaggtagctgacttcatcagagcaggcgagtgagagggctggagggagtgtgagaaagacagaagttccagtctcctaacctgatctcagaagtgacattccgttacttttactgtactctgtttgttagaaatgactcactcactagtttcaacctacactcaagagaacattatataagagtgtgaattgggagacattttagaagctgtctaccacagaatgcaaattattgcatgaatgatataccatttagaacaagggtatgggtttgaattctattccacatgtcttgaatgtaataatgtcacagcgttaaaaattcaacttgaatctgacagtccccatcctactggaatagctggaagttttatctcagtcattagcggggaacccctcaccttgtcacacacactcatgcttgtgctgaggttccagggtcatgagcaccaccaaagccctcgggaaactcttcagttatcaattgcctgtccacactgcttacttccaagttagttgtggtgctctcagctccataggcagtgctttcggggccagtagccttgctgctgctgtgccatcctggggcagggagtctttgtcaaggctgagagctcctgttcccaagacctggccaccctcaatgtaccctgtagtcaccctctttggagcatgactactaagaggaacacaggccaccaaactatatgtgtacgtaatctggcttttgttgttagtgtagaagtgacatacattctcttgcagttttctacattctaagccaaagtctgaactcagcgttctatgacctagaataagcaagacattttccacaaatataactataagtaatcttcaacgtaaaatctatattacaaaagcagaacacaaaacgtccttgttgtagttaatgtagaatcttacagaattgttctcacaaaacaacagcagcaacaacaacaacaatacacacacacacaatgataacaaaatgaagagtacacataatcttccaagaaagaaagcttcatcccaacttggttaatgggatgtttatattcttagtgtcttcaggataccttctgtgtgcatacatatcttttggttttttagtttatccatatagcaagatgtaatggccatctgtgtcaactgtcttttgattttttcaaaattctttgacaaattgcaatatgagtcctgtgctctctggctttagctctacttggccaagactgatttccattcatgcattataataagcaccccaataatagtgcaggttgtgtttggatctggtggttccataccacgtagccctagaccttgatttatttttatctgctcctttggacccttaggataaatacagagtacatgtatgttttaaatcagctctcatattccaccttatgacaggctttactttgtaacagattaactcactcttccctttcaccttacatatcctgcagacttccaaggaatgaaggaaaagattgcagttaccagtgtgggattgatatggtttggctctgtgtccccacccaaatctcatctcgaattgtaatccccacatgtcagaggaggggcctggtgggagatgattggatcacgggggcagatttctcctctgctgttcttgtgatagtgagtgagttctcatgacagctgatggttttaaagtgaggcacttccccgcctccctctagcacgctcgctaatgccgccatgtaacgtgtgcctttgcttccccttcaccttccaccatgattataagtttcctgaggcctccccagccatgtggaactgtgaatcaattaaattattttctttataaattacccactctcaggttgtatctatagcaatgtgaaaacagactaacagtgatgtatcccttgtcccagctttggggcagatctgtgtcagaggcagtggttagtctcagggacaaaacccctttctggtaggggttttgatttttgtaaaccttggctttgattctgtcatcctctcctgagaaggtaggtaggtggcttctgtgctctgtgttgttcagggaaacggatgctttgattctcatgtggtgatatagtttggatatttgtccctgcccaaatctcattttgaaatttaatccccagtgttggaggcagaggtggggcctggtgggaggtgtttgggtcatgggggtggatccatcatggctttgtgctgtcttcctaatagtgagttctcatgagacctagttgcttgtgtggcacctccccctcactatccctctctcttgctcctcctttcaccatgtgatgtgcctgctttccctttgtcttctgccatgattggaagcctcctgaggcccacccagaagcagatgctgctatacttcctgtacagcctgcagaactatgagccaatcaaacctcttttctttacccagcctcgggcatttctttatcgtaatgcaagaatggactaacacaggcctggaaaatggctggtcgcgagaggggcggccggttgctggggagggagtcggggctgtgtgggggcattggttcagccccagcggagtccgagtcggggtttgcagcatgttttgtggtgatgtttccaatctctttcccaaccaatggatcaggacggcgatcagtagcttggacggtcgcggatcctggctccgcaaacgttaaaggaaattgatgatgtctatgaaaaatataagaaagcaatgattcattccatgttcattaagtgagggagtgtcacaagaagatgaatttcaagaactatttgaagaaagagaaagagaatggtgagttcttcttctagggtaccatttggaaaatggctattcccagtgaattatccttcccaaatagcattttgatgctgttgttcctttctttgaggttcacaatggttcttaattttcatctaatttatgagacccagttatccagcacatgagctatgggagggcctttccaacatagctcacaataagcttactgctctggcttggcaaaaacactcctctgctcctcaaacactccttctccactgtgctctgggatgtagcacctgtcagtcctttactcagaatgctctcactctgttgagctacatgtttttcctcttctgaaattctgtttgagacccatcactctaggaaggcttccctactggctcactttgatttgatggtaagtatgtttcacattctgctgagactgtgagcctttcatgagaagggactgtgtggcactagcatgttaatatgtgggtgcccaataagtggtagctggctggttgtgccaggatccccttggtacttatgctacattccactcactgctgtgggctcaacttccatcctttgtgccaggaaagaaagccatgggagagataggatgtgaccagagaagaaagcctaggaatcacagaaaatgtgtgtgacagtagagacaaagtaatgcaaactgcaatgatgaattttagttatggttgccatgtgtatttgggaaaggaattagatgattctgattagcacccctcattaagaaccagacctggccgggcacggtggctcatgcctgtaatcccagcactttgggaggctgaggcgggcagatcacgaggtcaggagatcgagactcatgctggctaacacggtgaaaccccatctctactaaaaatacaaaaaaattagccgggcgtggtggcaggtgcctgtagggaggctgaggcaggagaatggtgtgaacccaggaggcggagcttgcagtgagcccagatcgggctactgcactccagcctgggtgacagtgagactccatctcaaaaaaacaaaacaaaacaaaacaaaacaaaaacccagacctgtggacaggactggctatatacgtatatacgttgtggagcttagtgcaaaatgaaaatatggggcttgggctcagaaacttaagaatttcaagacagcaatagcaaggcattaaaccaaattcagggaccttctcactgtaaggccctgagtgacccaattgtgcagcttgcgcatcttgtctataaaagattaacaagtaagagacagaaggttgaatgtgactcaccgaaaatagagatttctttatttaaaatcaaaaccaaaaaagcctattacattcccaataaaaattatagagtcatgttagactaaatcttcttggtctcatgggatacaaagagaactgactctatcttcaataagtcagagattttcaagtagagaaagtcaccgactatgtgctatctctgagagtaggagtgagtcagatttttatgttgataagaagagtgggccaggcacggtggctcacgcttataatcgtagcactttgggaggccgaggtggggggatgcaacatggagaaaccccatctctactaaaaatacaaaattagccgggtatggtggcacatgcctataatcccagctactcaggaggccgaagcaggaggatcacttgaccatgaaggtggaggttgcagtgggctgagatcatgccattgcactccagcctgggcaacaagagcgaagctccgtctaaaaaaaaaaaaaaaaaaaaaagtgaactttttatgttgaaaaacatggctctagaagagacataaatttggatatgaaagattgctgtgagatttgcaagagacagtgattggtctgtctataccttcattcaataaatattcatggcctaatatattgccaaaagccaagctgcatggccaacttcctcttgtattgtggaaatttcctgtgcttgctttactttggggcttttgggacatagggtgtttatcaatgcctgtgaatgggaaggggcaggagcaggcttgggcagagggagaactctgaattgagttgcaggtccaacaaagcctggggatctgcatttcttttttgtttattcttcttttagagacagggtctcacactgttgcccagactggagtgcaggggcacaatcatagcctcaaacccctggtctcaagtgatccttcctcctcagcctcctgagtagctgggactatagatgcatgtcaccagtaccagctaactttttttttttttgagacagagtctcactctgtcacccagactggagtgcagtggtatgatctccgctcactgcaacctccacctcccaggttcaagcaattcttgtgcctcagcctcctgagtagctgagattacaggcatgcaccaccatgctcagctaatttttgtatttttagtaaagacggggtttcatcatgtttaccaggctggtctcaaactcctgacttcaactgatctgcctgcctcggcctcccaaagttctgcgattataggcatgaaccactgcacttgacccaattttttattttatttttatttttattttattttttttgtagagatgggggtctcaccatgctgccagggtgatctgaaactcttggcactaagcaatactctcacctcagcctcccaaagtgctgggattacaggcatgagccaccacgtctggccagaatctgcatttctacacaagtttccagttaatgcccatgtgactgatcatggccacagtttgaatagcaaagttctgtagcaaactgactggttttcagctgataataaaacaatgaaggaagaaatgaacaactgctaactgtgtctatgggttcttcatggtttcttttttaattataatgatgtggaaaaactgtgagctatgcttaattatgtgatgaaaatgcaaataatactttcccttcatggtcttaaagaaatatttttgaagattaatgaggtgaatgattgaaaggctggtagagtttccagaaagcatggtactgctttagtgcttggcatgaatatgtagtggagtccacaggtgagtatttcctcggaaagttgttatgtgattctattatatttcagaaaaggagacttcagaaactgcatttgaaagtttcttattcacatcactgttcttagggacagtgggcacagaggtttgggcattttactgcagctttccctgctgagttagtgtaaccacaaccatattccgtgattagcctattaagctcccaagccctgggaatgggattgtttcttcctgaaggtatagagttggaggtgagcactgcagaaggcataactatacagtctagagatttattttttgaaaacaaaccagaatttagtaatctgaaagagtgttatccatcagggtgtctgcttataagaccacaaatgtatttcaaggatattgcagttgctcaacactcagtaattccatctgcccttttggatatccacgtcaactggcctttctcagccagggctctgtgcaagaattaagcctgattccctaaaggtatccattgtatatagtacatattgtatgtgataggaattaacttctcttctgtacatttagattggtactaattatgttccattcttggtaaaataagagtcacttaaattcttttctgtgttttgtggttcagataaggaacctggatggaaaggctgccagtgattcttattgttttcatagagctataattattaactggcagattgctgtgtaattagttcctgctataattattaattacaataatttaataattattaaattgaaggaagaaggagggagtcagaagtttaaagaaacagtaacatatttgcaacctccatttgagctgggccaggaaaatagtctttgacttaacaccaaaaagtagtatagtgcagctgaagattttcagaggcggagtagaggaggagagaggtagaggcaagtctggagtaaagatctcgagcagcactgtccaatagaaatacaatgtgaggccgggagtggtggctcaagcctgtaatcccagcactttgggaggctgaggctggtggatcatgtgaggtcaggagttcaagaccagtctggccaacatggtgaaaccctttctctgctaaaaatacaaaaatcagccaggggtgttgtcgggtagctgtaatcccagctactcgggatgctgaggcaggagaatcgcttgggaggcggaggttgcggtgagccaagatcacaccactgcactccagctagggtgacagagcaagactccatattaaaaaaaaaaaaaaaatcacaatgtgaacctcattttaaaaagtaaaaaagataaaattaactataataatatatatcatttaacccaaagtgtttttaaattatgatcaatataattatttttaatgagaattttacattctttttttgtattcaccttcaaaaccttgtatgtattggatttccagcaccacatctcagattggaattgtcacacttcagttgctcagtagtcacctgtagctagtgctactgcattggacagcacagctctagatgccatatcactacaaagattatgtaatttataattaaacagtaaagttgtatttttcaaaatgtcataaaatacaaatatgctaaaagtaaaaataagtcatttgtagattttctctttttttcctctctctcttccatctttccttctccctccattccttctgtctaagccttggggcactctacaatagagaggtcagggagaacaggaggcctaggtaaagggactgaaaaaagaccggtgaggcaggaggagagccaggagagtgtggtgctccagaagccatggtatcctggaaccagcttctgtcagttcacgagggctgattggtaaattttctggaatttagtaaacaggttgaagtatggtcattagtaaaaattatataatttaaataaattgtacttttaaaaagtagtactcaaaactcatttcttcttattttttttttaaaaatgaggatttatttgacaagttttacttagctcaatatacgtaaaaggaaatcacagtacaatggaagacttaaatcaaggcctcagaatctcatacaaacatcaagaccaaaatcctaaagtattggtattgcatctcaaatttttcccattaacttaaaaaaaaacaaaacttaaacttatgtgccttacaggttattaaataaaactagaattaacaaagaagccaaaatgtttcactttaattgtagacagacacagctcctatattgagttttacaacaaaaaaacccatgtctttcagcatgcatctacacagtgttcaatgtaatgtagcaaagggcaacagtgaacataattcaactccttttacctcaatacacttactgcttaagaacatcctataatataactaacttgagcaaagctggaacttgtttaacagttatagtttactcaacttcagtgttacatcctagatgagtattgtgttaaaaaatactgagccttaagtcttcataacaatcctgatttctacttagagagtaagcataaatcataagtttgtattgcagaaactgttaaactgaagttttgggtttttcttaaaaaaaaaattgagcaagggtcagtgatcaattatattccccatccaccactcatactggacatggtagacatccctcccattccattcacacctatagatgcacagcttccattactgtagtagctgctgttcattgctccttggctacctatgcaatgtctgattgaaaatcacatgagttttcctgtaaaacttggtcaaatccactcatgctgctgtggccaccatagccacctccataaccaccactcagctgcgggctggctgggccaccataactggactggattgacaagcccatgccccccatcatttggctaccgtaagcagtaccgctggctcctgctgcacaattcaagaagggttctacatagctgtgttgcatatttgctttgtcttttgacatagctgccacagcatcttcatgagttgcaaactcaacatctgcttcaccagttactctgccatcaggaccaatttcaatgtgtaccctcacagcattgagcagtcaaaaaaattacaaatgtcattctcagtagctctgtaaggtaatccacacgtatatacagtgtcctgttgtgctctggaaggtagagccaccatccccatatttgtgatcagacattcctgaaaaacaataattgaggtctcttccaaatctatctgacccaaatccatagccatagccattataattgtcacaggctccatatcctccaccataagcaccatgcctcatcctctgaaagccagctcctctgccaatgctgttaaaacctctgccagaaccaggtctgtcatgggacctggccgccgcatggccataagcttttatggtggattgtagtgagttccaacttcagccctgctgcttttaaagatttcaatatacctgtgccctattctttccttgtgtttctttagagccttttcggttattttctgcgaagcaaactgcacgaagacctcccctatactcctcccctggagtccactggcaatgttatccgatttggcacgatttccaaccctgagaagaactgaacaatttcttccttgctgcattcaaagggaagtcctctaagctgtacaaagccatcattggccgtgtcaggactatttcgaccggtatgcttcaacacccaatccatttcaacgttgtttgacttgaatgcttcaacaaaactgtgtcccatagtttctctgtcctttttcagggccaatttgacttcattttctgattcaagttcaacaaaagccttgtcacccagcctgccttctctgttgtagatgaaacgaataccttgagccttattttgaattttgcagtcagaagaaacgctgcacttcatcggccaagcaagaccagggcaagccgtggaccttcaacataaacccctcgccacctttggtgcccaacatcattgtctcttacctggtctggtgtcaaaacagaccagacacctgacttcggcagggctaaaaagaaatggcccacttcttaattattttggtagactttactagtatctatgctcctgagattatggctgttgcatctgtgtggtggaaatactacataatggagtgtactactgttcatctctttctaactcagcagtcacgctggtagactgaaattggccatagtggaagtacttacatcacagaaatcagcaaaggcaacaaattggaacttttgaaaatttttctggagaacctgttgttaaacatttaccagcacactactgcctggaagccaagagaagatggagtatcaaggggagaggaatcagttgtatcaagtgctgctaagatgaggttagtaacgtaaggtttggaaattgaacattggattaagctccatggatttcacaaggactaaaaaagacaaaatcgctgcctttgtggaacttacattctgatgattgacttggaaatttaatagcaaatagaacagaaaaaaatgtcctgccttcatgggttgggatgtagtaggcattttgaaggacctgctgttcttggaatagtaaatttcattctctccaccttctaagctttgtatgttctctgtgtttagactgccctttgctgtcttattctgctggtgtacatctgtctattcatttctttaggattcagctcaaatgtgtattcctttgggcagctgtctctgaactttgcaggcaaaattaaatgcttgccctgaatattcctgtgtttttcttatgcctgtatttttctcattgctgtaatgatggcccatttctacatctttccttgatgagcccactgactgataatggctgcgatcttcatctttgtatctcagggcctgccaccatccttggcacatagtagatcctatgtttctctacatctttagagactgaaggaatcaagtaattaacctgggattaagatattgagatctgatccaaggcagagggaccacaagacctactccatggggggatgtaaatggttgtcagtagaactgtgcttatttctgtctctggaccatttgacactctgtctttatcattctctctcctgatttgaatatctaatctggggcctgaaacaatcaatgtgctatattataaaataaaacttgtttgcttttctattcagagaccttttattgctaaaattttccacttgttaccttttctttctcaatcaatttacactttgaatttattcatttgtttagcaatttccattttattttcatctcctcatgttttcttaaaactaagttacttcttagcatcatggttacatcagggatcatttggttgcaaggaacaaaaacatgttcaatctactttaataagcagcagtttattgcattgatataataggcaatgtcatgggcatccacaggcagggacttaatacaacagggtctcttgtgttccacatgagcacttgtactgaactgtcagtcatcacatggactctcacccttgcttctctctttgcttttattcactctctccttagccatctttcttttctcgcatgtctaaaacagggctgccagaacccatcacctgatagctccactcagctgactttgtttcacattcccatgtgagaggatccggtgagttagccaggtctatgaaccacatgtaacctgggatcctatctcgatgaaagggtgtgttcttcatttcctagggatgttgtagcaaattaccacaaacttggtggctaaaaaaccacagaaatgtattctctcacagttctggagaccaaaagtccaaaatcaagatgtcagcagtgttccttctggagtctctgagggagaatctgttccatgtttttctttaaaaaaaaaaaaaaaatttttttaagagatggtcttgctatgttgcccaagctggtgttgaactcctggcctcaagcaatcctcccacatcagcctcctaaaatgctgggattacaggcatgagccactgcccctggtcttatttcatgcctctccttctcctagcttgttgtggctccagcaatccttggtgcttcttgatttgtagacacatcatgccaatctctacttagtcacgtggtttttccttgtgtccctctgtgtctgtctcttctgtttcttacaagggcactgattattagattaagggccaccctaatccaggatgatcacatttcgagatctttaccttaattatatcagcaaagactcaattccaagtaaggtcatattagggtaccaggtagacatatcttctgtgggccactattggacccactatgggaggtgtatgggagtatatgagaggtatagtcaaaggctaccagcatggctttgaggccccattgcaggtgccagtaaatgcctagttgttccacacctctaccaggaatacttgtcactttatcattttgaacacttactttcaattaacatgttctgctgaaatgtccctttctctaaataactttcagggactcacatcccttagggcggaattaatgacttgcctttcccatttcccatagcattttatacacacctctgacaacacttgccattttcatttatagcactttgtttacgtgtccattttcccacttaagttgtggacttttcctgggtggggcctgttctttactcagttttgcttccgcagtgtcaagcacaggatccaactttgagttatgtttgtggaattgcgttgaaagtctgggcttcatggattgaatttcttcccttccagccttagtgttacttgattcaattgtgttaattgtccattccagccagtttcgtctgggattgtactctgttgtgttctctgttacatgctcagctctgccccgtctttcctgctgccacaacctatgttagccctcatcagcatacttctgctgcccaaattctttaggccctgcattctcaagttgtccccaccaccccttctgttcaggttaatcttcccttttgcatgcatgtgcccacacatggggatccactttacatgtttatcttagccatggtcgatgcagttaggatttccaaattacattatcagtaccaaattaggtttgaaaaaggagagggagcatttctttcttttgcaatcttgtcacagtgtttcctgtggtcccagaaatcatggtggaaagaaaattgggatttcaggaaacattgcttgattctgcaggaagtgaacaacgttttctaatgatttccagaaaaagaaatgtcatatttttctggagtactttaggaggaagtagtgcagtcagtggtgggaaatatgtcctccactccctgttaagttctctgtggcagatcttacatattgccagtgagttcctgctcttatttaaagaatgaagataatgatattctgcagctatgaattttgagttcaactatgtagttgctgattttctgcctactgggtttgtccatttccaatacaggggtgtcaatatcttcactatcatagtggattcttctatttcccattgtagttctgtcagtttttgccttatgtattttgatgctctgttggtagatgcatacaaattaaggactgttatgtcttcttggagaattggcccctttaccattatataatgtccctctttatccctgataacttttcttgctctgaagtctgctgtttctgaaattaaggcagctacttcaactttcttttgattagtgttagcatgatatctctttctctatccatttatatttaatctatatgtgtctttatatttaaagttggtttcttttgtttccttttgtttgtgtatgtaaaatgcaatcttccttctgcagctttctttattgaagtgtttggtatatatttggtgctagcatggccattgctaattcatgaatttttttttactttatttatttgtaatttcaacttttattttagaatcatggggtacatgtgccagtttgttacatggtatattgtgtgatgttggggagccagaggggaaaataaaccacctttcctataaaggcacaaaagaattacatccaatgtctcctcagaaatcatataaggaagatgaaagtagaatgaaatatttaaagtgttaagagaaaaaaacccccaccaacctagaattgtttatcctataaaattatccttcaaagtgagggaggaataaaaactctcggacaaaaattgagataatttgttgccggtagacctgccttgcaagaaatgttaaaagttcttccaagagaagtaaataatatgagtcagaaactcagatctacataaggaaaggaagagatcacagaagaaataagtgaaggtaaaagaaacacttctatttttcttattgtgagttgacctaacagataagtttgttcaaagtaataataattataacaatgtatctgattaatatagtttatgtgtaagtgaaaaacagtcattttacttttcattttctacagttttaatgatatacctaggtgtagtttttctggaatttatctcacttggtgttctctgagtttattggatccttggtttgttttctgatgttaatttgggaaagtctctgtttttactgctttaaatattgtgtctgttcttttttccttcttccctttctggtattcccattatgagtatgttacacctttgcagttgtcctgaaattcttagatactattgtttatttatttttagtttttttctctttgcttttccactttgcaagtttccattgtcaaatcctcaagctcagaaattatttcttcagctatgtccagtctacctgtgaccccaataaaggcattcttcatttttgttagtgtttttaacctctagcatctcttttttatgcttccttagaatttccattctgtgcttaagatatccatctgttcttgcaaattgtctactttttccactcacccttagcatattaatcatagttattttatatttatagtctgataattttaacatccataccatatcagggtctggttgtgatgcttgctttgtctctttaaactgtgttttttgccttttagtatgccttataacattttgttgaaaggtgaacatgatgtaccaggtaaaaggaactggggtaaacagacctttagtgaggtcatgacaagatgtgaagggagaggaagtgtttgacagccctatgattaggtctcagtcttttagtgagcctgtgcctctggactgtgaacttcacaaattgtgttaattgtggtacaggtggatttcacttaggtggtacaggatggcaagagagggctgtagtggggtattttctttcccattaggttaggctcttgagggcaggtgatatggtttggctgtgtccccacccaaaatctcgtcttgaattgtaatccttgtaatccccacgtcaagggcaggaccagatggaggtaattggaacatgggggctatttcccccacgctgttctcatgataatgagtgagtcacatgggatctcacggttttttaagtgtctggcatttctcctacttgcacccattccatcctgttgccctgtgaagaaggtgcctacttctccttttccttccgccatgattgtaagtttcctgagacctccctgagccatgtggaatttataaaggaaacctctttccattataaattacccagtctcgggtgtttcttcatagcagtgtgagaacggactaatacagcaggccttgttaagaagaacgaaatgctctagtatatttcaaaatggttactcccctctgtccctctgctacctgctatttttctctaatctttgctatgagaatttggtggttcttatacgagctcctgtaggtaaaactcacaaagtatgagggcctctttatgactcgggctccctggagtttttgactcttatacttgtccacactgagccttgagtgatttaacaatgataattcaggttttcctaccctggtactggttcctgtggaaatgagtttgtgttctggggagctgtgattctctgtatatccacctgtctgtctctccaattttggggacagtggtttgtcctgtgacctcacttctctgatggatctaagaagaattgttgattttcagtttgtttagctttttacttgttgttaggacagatttatgccatttaagctccttacatggggaaccagaacctggaagtcccagctgtaaatattgaaggcataatgatttcttaacttttatattctgatgcgtattgtttggttctctgcctttccaaaataggaattgaccccataatatttctgtacattttaactgggaatgttaagacctggataaattctaatcttggctctgctgctaatgatgttaccttgggcaaatcagagactgagttttctcatctataaaagtgaagggtgcagactcatttctaagtctccttctagctttaaaattctgaggtgggcggatcacgaggtcaggagttcgagaccagcctggccaacatggtgaaactccgtctctactaaaaatacaaaaattagccaagcttggtgtcgtgcgcctgtaatctcagctacttgggaggctgaaacaggagactcgcttgaacccgggcaaagttcagtgagccaagatcatgccactgcactccagcctgggtgacagagcaagactccatcttggaaaaaagaatctatattttatgatgttacaaaatattctctgattttgaacactaataccagtactctgggtaaacctgtgtgctcaagcaggtgccctattatactttctggaatttaaaaataaactttttattttggaataaatttagatttatagaaaagttgttagccagacatggtggctcacacctgtaatcccagcactttgggaggctgaggcaggtggatcatgaggtcaggagtttgagaccagcctggccaacatagtgaaatcccatctctactaaaaatacaaaaattagctgggcatggtggtgtgcacctgtagtcccagctacttgagaggctgaggcaggagaatcacttgaacccgggaggtggaggttgtggtgagccgagatcatgccactgcactccagcctgggcaacagaaaaaaaaaaaaaaataaaaataaataaataaataaataaataaataaataaataaataaaaagaaaagaaaagttgcaaagatagggctgggcgcagtggctcacacctgtaatcccagcactttgggaagccaaggccgatggattacttgaagaccagcctggccaccatggtgaaaccctgtctctactaaaaatacaaaaattaggtgggcgtggtggtgcactcctgtaatcccagctattctggaggctgagacaggagaatcacttgaacccaggaggcggaagttgcagtgagccaagatcgcaccactacactccagcctgggtgacacagcaagactctgtcccccgccaaaaaaagttgcaaagataatgcagagttcctgaataccccttactgttttccccattggcaacattttatattattatggtacatttgtcaaaactaaaaaccagatcatgaatggtacattactattagccaaactctaggcttctatttggatttcaccagtttttccattaatgtcctttttctgttccaggatccaatgcaagctaccatattacattgagtcatcatatctttccaatctcctctggtctgtgacagtttctcagtctttccttggttttcatgaccctgatggttttgaagagtgttgactagatattctgtaaaatgtcctcaaacttgggtttttctgatgttttcctcattactagactgggcttgtgggtttttggaaagaaaccacaaagatgaaatacctttcttgtcacattatatcagggattggttatatctatataacatcactggtgatgctaactttcattaattggttaaggtagtgtttgccaggtttctccactgtaaaatacgctttttgtctttcccaactctgttctttggaagtgagtcatcaagtctagcataccctgaaggtgggagaagagagggaattaaacttcattcacttcttaaagatagcagtatctacagatcacttagaatttttctataaggaaaattagtctcttcttccacatttatttatgcaatcatttattaatattaatatgaagtaatgtatatttattttatactttgaattataatccagtatacattattcacttttttgctcaaattgttctggctttggctggaagttctttcagattggttcctgtgtccctttgacatgctctatccttttgctttttcaacatttccttactatctggtactacaagatactccaggcacattttgtattttcgttgcccaagtcctgaaatcaaccttttctccaaaaagctctgggttttaaaacaaattacaatttatctgttttggtttttataagcattgccatgatgaccatccttgatgttatatctctggaaaactccatgattatttcttttagataaatatctaaaagtggaattcccggattaaaggcatctaaaatgcttttactatgttttccactaacaaggtgtgagatgggggggctgcctcaggggctgcaactcaaagcccacttcaaatgggaaacactatccatccgtcaatccatttatctatcttagaactctctttctatgactttcttattttcaaaacaaacaaggaataaagaaagaaaaaaatgaaacaagtaaacaaaagacctctcatctagactctctaaccacccaacaaatcacattgctcctcctaggaggaaatggttgaggtgtcagactgagaatgacatctatttcccttcatggggagagcacttgttaattcacctattaattcacttttaaaatataattttacattttatcaaagtaatacatatacatagtttaaacattcaagtggcactctaagacttaccacgaataacagcaatacagtgctatatcccttcccattgccaaactttcttcacagaaaaaatcactttcatttcttttagctttttttttttctggggtttatttccatatctataaagaacatgtttatactgcaatttaatttttttttcaattttagacattatctattgacttcttactaactatggaagataaagactgaagtctcttaccaattctatacacaaacacacacatatgtgcatcctttcctaaccccattctttcaatatagttataacttttgttaaatccattaatgttttcattgttgtgactctatagttattcatagctgagccacatattggactttaaatatattttcttatataacattttctttttcctggaattaataattatgccattttttggtttccttaacttactgagccgattactcatccttctccaaactttctaagagtgctgcaaaacttttcaagtttcaacatctgtcagatccattgggtcccctccatgtattttttcattggaaatatccctccttgagcctggcgtctgccactcacttgggctagttgctctccaagcctgttgtactcttatcatcttgggatctcccttggccaccattcttggaattctctctcttctatttgaaatttgctgtttttgggagcccatttttcctttttgttttggcttatgctcttgtttttgtagtcacttttttcaataacatctcgaaaatggtcacatgggagataaagttcttgaaacttggcatgttggaaaatgcagtttcaagaacgttgttttacctttctttctgatggatcatttggatgggtagagcatcctaggtgagaaataattttccaatagagttataaaggaattgatccattgctttctaacttctggttttgttattaagtctaaagccattctcatccttgatcctttgtatgtgacttatttttttcctatctggaaacattttttttctgtttattcttgatattctgaaacttcactgttttgtacttcagtgtagatttattttcatttattatgctgtttacagtgggccctttcaatctggaaacaaatgttcctcaattcttgggaattttattgtatcacttctctcattatttctttccctccattcctctgttctgtgcttctgtactgctggtagtcagatgttggctattcttcatctctttgtcttttcttctatcttctggaagatttcctcaactttattttctagtctttagacttcagctctcatattttgaatctccaagagttcttgttctctaattatgcctttatcatagcatcctattcatattttgtgggtacaacattttttcttattttctatgaaggtttaactaatatttcttttaaaaaatattctgctttctgcattgcctttctttcaagttttttccccccatctgctgttgggatgggagaaatttaatgaatttggctttgtggggttaggattaggtagtctatttctttttcagattttcaaccaatcttatgatttttgtttcagaggtatagtcaattctcattattccttcattattcctggcaattatgttcaataaaatcgccacaaacactgaattagaaaatactgctgagcgtggtggctcatgcctgtaatcccagcactttgggaggccgaggcaggtggatcacctgaggtcaggagtttgagaccagcctgaacaacatggagaaaccccgtctctactaaaaatacaaaatcagctgggcttggtggcgcatgcctgtaatcccagctacatgggaggctggcctgaggcaggagaatcacttcaacccgggaggtggaggttgcggtgagctgagatggcgcaattgcactccagcctaagcaacaagagcgaaactctgtctcagaagaaaaaaaaaaagaaaaaaagaaaatactgaattattctctgtgggggaaatatagagttaggtgcctgtgagcctctggtcacaacatttttgtcagctaatcaatacataaccttgttttgtgtgtgtttctgtttaaagacaccttatttaatatacattgttgattcatcaacattgaactcatggctaataacagtactatgactcatgcctgaatagagcttatttaacacacatattttctccatgaggcacagcctccttctgcttaggaacaccagacagcactccagcactctgcttggggggcattcgaaacagcaaaatcactcataaaaggcaaaaaattgcaaaaaaaaatagtaataaccagcatggcactaaatagaccatgaaaagacatgtgtgtgcagtatgaaaattgagacaggaaggcagagtgtcagcttgttccacctcagctgggaatgtgcatcaggcaactcaagtttttcaccacggcatgtgtctgtgaatgtccgcaaaacattgtgagtattgatttggggggttacaaataattcctagcaagtaggtgaattcacaaataaggaagctgtgagtaatgagggttgattttacctacctagtgtctcaaatcctgagccgtatgagattccgtggcataattatgtttgcttattgttggcaaccttattaggcatttctaggtttctgctttctcatctttaccagttcagttatggcttgattcatttctctttttccaaagatttgttgacatctcttatttgctgttgcctcttcccatttgttttgtcttgtggttctatatctttgccataatttttgtggagtttcctgagagagtagagataaatgtatatgctcaattggtcttgtcttaaccagaattctatttaatacacaacacctttagtgagctgttatgcatgtaataggtgtttactaagtattggttgaataaattcaagaaatgcttgctatttttgtgctagcatttagcttttctctatagtatattataatggaattttattttattttattttatttattttttgagacagagtttcactcttgtcgccaggttggagtacaatggcacgatcttggctcactgcaacctctgcctcccgggttcaagcgattctcctgcctcagcctcccgagtagctgggattacaggtgcctgccaccatgcctgactaatttttttgtatttttagtagagatggggttttgccatgttggtcaggctggtctcaaactcctgacatcaggtgatccacctgcctcagcctcccaaagtgctgggattacaggcgtgagccaccacgcctggctggaattttaaatatctcataattataatcttctaggtaaaagactagctctctttctcacccttattcctcctacttagtggaacattgcctaaggaagatggggaatgggttaaaaattaaaatgtggggctggaaagcatagcttgttttaaaacttagttttctttccttttgcatcataatctcttccccggtctatttatttctcgtggttttgtcagtccattacaaacggttgcaaaattgtggtactagaagggatcctagaaataatctaatttgaacctttgattgctaggaaactgagagtcaggctgccttggttcaagtcttggctccaccacccatgtaggacatgttgcttactgttttgacctcagtttccttgcctataaagtgggaataaaaatactcctgatgttataggattgttgtgaagattaaaagagataattaatgtgaagttcttagtactatgcctgacacacagtaagagctccacaaattattaatgatgattattactagtggctaaactgaagctctggtttctcagttcagtatgttttcctttagacgtaaataagaatttgtaagcctctttttggagtcagctaccattattttctttccttcatctccttcattgtctaaagacagttaacatgattgcgtatttctcatttcaagctaaagatactctcactgtttcagctattaccacatttgtaaggacttcctgaagagaaaatttaaaagttagtcacttcttttagttgtttctggtctttcagatgatcctttttttttgtagagttgagtgtttttgtttttgcttttgtttttagttaacaataatgcaatccatttcccagcataagtgggtaagtgccactttgacttgggctgggcttaaaagcacaagaaaagctcgcagacaatcagagtggaaacactcccacatcttagtgtggataaattaaagtccagattgttcttcctgtcctgacttgtgctgtgggaggtggagttgcctttgatgcaaatcctttgagccagcagaacatctgtggaacatcccctgatacatgaaggtgagtgctaattcatttagaagagtgatagtttgatcatctttttctactttataaaagtctttttctgttttcttcagtgaaattatgggtcagacccaccacgtgaatttctccttgaactggttgttgatagttaagggaatctaatcttttggcaggcaatattttaaaatgctgagatcagaatggagaatcatgagtgttagaggtgaaggattggggaaaatatctgaaataatggatttatctttcaggaaactctaggctagagaaaattagacctagaggattcagaggaaaatccttgtgtgtactggtatttcatggcaggagagctgagagagagtaaatcactaatagctaccacatgattttagtggaaagagtccaggtttggaataagacagtcgtgagtttgaatctcatttatgctgcttacaaactattatttttggacaatttacatgatatctcttggcctcagattccatatccgtaaactagagatgagtaatacaaaccctacacggatttttagaagtacaggatgtaatttgtatagtgtagttagcactttgcaggctgtcactgttccaacatgatagtgcttttgccagtctcactactggctgtctcagaatgttctttaaatgaaggcagcccacaacccaaatggatttatagactttgaaactggaggtagtcatctgacagctcgcaatctcatcttgggcaatgtatatataatcaatatcctcatccaaaaagtaaggatgtcattattttattaggctgaaattgccaagatttaactgtttttgacttaataaaaatagcaatttcatttgatttaacctaaaacataatatagaaataaaatttaaaatatgcaggccgggcaaagtggctcacacctgtaatcccaccactttgggaggtcgaggcaggtggatcacctgaggtcagaagtttgagaccagcctggccaacatggcgaaactctgtctctactaaaaatacaaaaattacctgggcctgttggcaggcacctgtagtcccagctacttgggaggctgaggcaggagaatcacttgaacccgcgaggcagaggttgcagtgaaccgagactgcaccactgcactccagtctgggtcacagagtgagaccccgtctccagaaaaaaaaaaagaaataaaatataaaatatgcaactataaatataaaatatataaatagaaaatataaaaatatctgtctcatttacctgaagggtgacaagaatctaaggagatagtatacatgaaagtgcttgtaaatctaaggccattattactgcgactattatcattactgcaagctccaaataaacatttaaaagagactgagaacagggcacccttctacttgatcagtgaaagtataaaccaagtcctgtgggtcttgaggaattctgaggcactgagagaggctgagcagtgcatcgcttgactacctccctctcagtgttatgagtctgcaggtgcttgaacttatggccatagtgctggccctagaagttactccctcttctttgccattttttatttttttatttgagacagtctcactctgctgcccaggctggagtgcagtggtgtgatcatagctcattgcagcttcaaactcctgggcccaagcattgtcccacctcaacctcctgtgtagctaggactacaggtgtgcaccatgacactcagataatttaaaatatatatatatatatatttttagagacagagtcttgctatgttgcccagactagtcttgaactcctggtttgccattctttaaaaacccagttctatactgcaggagatagtgtttggcacagaatgagaatcaacaaatagtagctgagtgaatgtatgaatgaatgaaccaaaggaaggcaagccctgggaaaatcacgtagtggtacattcttgtacaagtgaaatgagatgaagctcagcacccaggacacagccttgagtgggagctgaatggccaaagagcaccctgtgaagtatccattttatgggggattgcgtgggagtaaaacagccacactctatttcctttgctttggtcctgtgagacaggatgtggggaggcagggataatttaacatgctgaaatgtgtagcgtttcccagcagaggcagtagcttccatctttgctttcttctcgctgtgttcccagccactgctggtagtcagtaataagtgcttagatttgtttgcagtcgttctactccaaacagtagctgctactaggtttacatctcttttgttgttggttttgttgttgtttgtttgtttgttttaagatggagccttggtctgtaacccaggctggggtgcagtggcacaacctctgctcactgtaacctctgccttttgagttcaagcaattctcctgccttagcctcctgagtagctaggattacaagtttgggctaccttgcccagctaatttttgtatttttcgttcagatggggttttgccatactggccaggctggtctcaaacttctgacctcaagtgatctgcctgccttggcctcccaaagtgctgggattacaggcatgagccaccacgcctggccaacatctttaagcataggacaccactagttacttaagtggcatcactgtatattctaagagtcttttagttcaatatggcatatttgtagtgttgttggaagattttatagagctctgctaaatgctgtactcaaatgagatcccaccaatgtgagattgtttctaggaaatgacccctttttgaagaccagttattcaaaactgctgcatttcaaagttaaggctgatgacccagggatgcaggaaatgattgatggctctcctcaagagcacagcagaatctttgggaatttcttatggcccagatttggggaggctgattcacctcatttaagtcttcaagagactgatatattgaaaccaataagaaatagtctttctaatgcctggaaggctcatattctttgttcagggccttcttccgttaaattagtaatcagagagggcatcagagaatcagagcaatcagaaagggagattcggggttttgaagtatctttcatcaggttcatggtgaggtcttgtggctgccctgtcagagtctttcgctccagtgacaggaaatttcataatttcctttcgtagatagtactggataaaaactgccaacttctgtcttttttaaccatcaatattttacattctaaggtgacctctcctttctttcctcaaagtcttctgtttaggatacaattagttgagtagattcccgcaactaaatgataatgaaggttttccaaatccaactctttgagattatacacaggtttctttggctggagtcctgaatgaactcaagcttatcaactgcacatctacccaccacagataaccaggatcaccttgaactctctactggacttatttctaagcccctgggaggcatctcacctttttgcattttttttttttcttttttgagacagcatctggctctgtcacccaggctgaagtgcagtcatgagatcacagttcactgcagcctcaacctcccaggctcaagccagcctcccatcttagcctcccaaatagctgagactacaggcacatgccaccatacccggctgattttattgtgtgttttgtagagatggggtatcaccatgttgctcaggctggtcttgaactcctgacctcaagtgatccgcccacctcagcctcccaaagtcttgggattacatgttgtgagccactgcgcccagcctttgttcacattttttaccagcaagcagtcctttttgtggtgagaggagaatgtgggaaaggctgtggaggacaagcaagtattagaatgagagatttcatcctaatggcaaggcttgttgacttcccacagtcattagctcatttctctttttagatgctctttgcgctcatttcactattgtaactatacttactatgtgatatatgagactactatccaggcttctgtctctgcaagtggaccagtggttcttaacccatttctgttcaaacctactgcagaaatatgacatgagagtcctcagtaacagcagttcactctgaaattggtagtttccaaaaatattcctgctatcctctccatccttttctcccttccctttgttaaaaatcactgaactagaatatgagctctttgaggtcagagatgtgctcttctttgattccaaccacctaacacatggctgggacagtgctgaacacatagaagaatgcctgaggtcaccagtttgtttgtgagagggccaggaccacaactcaggcagtctcaatttctagaatgctacacttttcaactactgtaacttttccagttttgtctctgggatgatttagtactgctgatttttttctaaggttttttttttaaatttcacaaataatagctgagtatttttattgtaaaggagtcaagcaataattaccattaacttaaaaatattttaatattttattcaacatttaatattgataggattttaaatgcaaaaccgcttgtcagaatagcaattttagttttagcatctattattattcattgattcacttattaagactgccagcatcttggctttcatagccttcctttttaatgtgcttttaggacttgtaaataatgtgagctaggactaaaggcgtgtcttcttcttaacagatggagaagattaagacaacattctgaataattagacacaaaaagaatgttcttagtgttatagttatttttaaagacaccttttttcttcattgaaaaattgaaatgtttccctttgagttatatacccatttaaatcaaaatggctatctttattatcttaggcagttccaattcgctaaggatttcagttggttcatatgtgagaaaatgttatccctctaattttctccagaaatcctgcatgcacatttttctaaagtaacttattttgtaaagaacccttttcttttttttttctataatgatctggcagatgaaaatgtaacatcatttatttcttcctgaaatgaattactggttttacatttgctttattcttagactatcccaccatttcatcttagatgagatgaagagccagcattctttttgttccaataaacaagtaaatgccacaaacagtattgtctaccaggtaccaggcactgccttagataccaaggcttcaaagaggaagaagagaggttccactcttaagaaggtccctgtatgtagggaagccgtcaggtaaattgctgaccaccattcttgtggcagatgctgtaggacacatgatatagtggggcatggggcacaaaggagggaccaactggcatctccatgcgggaattcagagagggcgtcttagggaaggagagccttgaaatgagtctggaaaggtgattaatttgtcagaaataaggggaaaggagcactgtgggcatgcatagagcatggagatgtgagatagcgtggtgcttggcaaaactgtgagttgttccatttggctggagggcctaggcactgaggcaagggccagaggatggcctcatagctgcacatactcatttttttttctggagcacattcttggtagttggtatacttttcataagacatagtggagtagacgatggacgaaaggaaaacgtgttgtaattgcaaatctttaaaatgttgactggggttgatggagtaattatgaaggatctaggtgatgatagtcaacaaataaaataaaataggatccttcctccttccaaaatccccagaatctatttgccattggaaatagagcttttgaaaagagatatgaagcaaaccaactcttgactgatgtcattttcagctctctccccagccttcatgtgttaacctggggatgatgtggacctgggcactgtggatgctcccctcactctgcaaattcagcctggcaggtaggttgacctgggcccttttacagatcatgtgattattattgccttctttggacaagagttgttaactttaaagcgacacctggattatggacatccacagatagaaaaggggacttgtgaacaccctgaatttgtgtgtgtgtctgtgtgtgcacacatgcatgcaatttcacatatactcatgcatgtgcaaatgtggcaagatggcttaccatattttcaaagggagatacaacccccaaaatgctgagatctactgttttagaatatagtagtctctccttatctgtgggggaatatgttccaagatcctcagtggatgcctgaaactgtggatagtaccaaaccctatatatagtacatttttccttcacatatatacctatgatgaagtttaggtacatttaggcatgaagagattaaaacaataactaataataaaatggagccattaaaacaatttactataataaaagttaggtgaggtctggcacagtggctcatgcctgtaatcccagcactttgggaggctgaggcgggcagattttttgaggtcaggagttcgagagcagcctgaccaacatggtaaaaccccgtctctactaaaaatacaaaaattaaccgagtatggtggctcacgcttgtaatcccagctacttgggaggctgaggtgggaagatcacttgaacctgggaggcggaggttgcagtgagcctagattgtgccacggcactccagcctgggccagagcaagaccttgtctcaaaaaaaaaaaaaatgttatgtgaatgtggtctctctctctctaaatatctcattgtactgcactcacccattttcagatggcgttgatcactagtaactgaaactacagaaagtaaaaccatagataagagggaactactataataggaagtgcttatctccatagtttttgtgttgttgttatggcttcatataatacacatacataaatacaaaaataagcagttttcatactatttgccataaagggaaataatgaaacaacatttctatagtgttccaactcaagactacaggcctgatatccatacaatagcttgtagatctaagatccatttgtttgattatatcttaagtttaaaacaatattaagagcagagacactggtctggtagtgggaaggtggggaaggcgtcatgtagcgtattcgtgtgcttgggctgccataacaaaatacctcagactgggtggcttaagcaacagaaatttattttctcacggttctggaggctggaagtccagtgtcaaggtggcagcagggctggtttgcaggtggccttccttttgctgcctcttcacatggtcatccctctgtgcccacacaaccctggtgtctctcctcctcctaaggatgccagtcagattggattagggcccatcataatggtcccattttaacttaattacctcttcaagtgctctatctccaaatataatcacattttgaggtactgggggttaggacttcattatgtgaattttggagagacataatttagcctataacatgtactaattggggtcaccaagagggcagtcatgacccagagataatgagaatgccttcagacttctgtcctggcatggcctgccttagccccttggggttacacctgtggcactcaggagcttgatagaccaggggtccccaacccccaggctgcagaccatgttaggaactgggccacacagcaggagatgagctgctggtgagccagagttactgcctgagctccgcctcctgtcaaatcagcagcggcatgagattctcatgggagcacgaaccctattgtgaactgtgcatatgagggatctattaataggttgtgtgctccttatgataatctaatgcctgatgatctgaggtgaaacagtttcatcccgaaaccatccgtaccccaggtccatggaaaaattatcttccacaaaactggtccctggtgccaaaatgtaggggactgctgtgatagaaaatagatgatacaggcaggcaggactattgctctccctctcatcagcaattgctcccagttatctaatctaaacttctaattacagacactgtggctcctatcaagtcaccctttccctccacttgtctttttctgtcttctatctctgttttccactcttcctatgttgtacatataccagctcctacaaaactggctccaatatccaccattcttttcatctagaatatccttcccttggtcctgctcagccttgctcttctatgtcaagatatttttcaaaacactgactttgcaacagcaccaaagtgatatgagtatagagggaaggagggagatggagaacatctctataattttggaaaatgttcctcttgcgtatgggaaattctctgataagcaagaacattctcccaatttttcttagaggaagtgatgaatgtttttccccttatttctagaaataggggaatattgctatggttcgtattttgagggaatagggaaagaaagatgggagtgaccagcaagcctaaccttcagttgtttgtatttataaaataaaaattctattttgactaattttagatttatagaaaaactgtgaaaatagcatagagagttcctttctaccctcatccagtttatccattgttactatcttataatacaataaaaatttgccaaaactaagaaattgattttggcacattactattgactaaattccaaattttatttggatttcactagtttttccatgaatgacttctttctactttatttttaatttttttttctgagacggagtctcgctctgtcgccctggctggagtggagttcagtggtgcaatctcagctcactgcaacctctgcctcctgggttcaagcaattctcctgcctcagcttcctgagtagataggattataggcgtgtgccaccatgcctggctaatttttgtatttttagtagagatggggtttcaccatgttggcccggctggtctccaactcctgaactcgtgatccgcccatcttggcctcccaaagtgctgggattacaggtgtgagccactatgctcagcctgaatgacttcttcctattccaggatccaatttagggtaccacattgcgttgaattgtcatgtctccttggtctctgccggtctgttacaggtccttagtctttccttactattcatgaccgtggcagtcttaaggagtactgacaagtatttctgggtttagggggaaaaaggcaacagaggtgaagtgttcttcattgtgcatcacaattttacccatgtttgtgacaatcttctgagggagaattgaataagacttaaaataggcacactgattgccaacaaggaggaaggcaggacaacagatgtgtaggctctgccagccaaggcagttctagtacatacagccaaggtcgttcagctatgtggaatcactccagataactgaaactggaaaaggtaaagaaaatctagaaagtagaagtgaagtctaacattgttgatttggttcaattttattccagtttccctcaaccccctaatctgtgataaaatgaatctaaaatcctcatatgcagaattaaaatgtcatgaggacacaaaactagggaaagctattgttaaattcctcctccaagtctgagaatactggagagaacaggctatttaggtattagtcagggagagttgtttatgctgtaataataaacaagcctaaaatattagtatttaaaacagcaaactacatgtccatcacaggtaagcaggggctcaggctggtggggctctgctatcctcacacacaccatgtcagcatccgttttcaaggcgtgcagtaacaggaggaggagagaaaagagagtcatgcgccatcacttggacgcttcctctcacatggcaaaggccaaggcaaatcccatggccaccctattgatgagcactggaaatattggtgagcattcattttatctaccacaaatctcttctgtaacaccaatatcaagagagcctttgtaagactattgttctctcttaccatgtgccaaccagtaagggaaaaacaaatgtagtctcataagaacagcctgggttgagcggaaaatcatttttggaaccacttactcttctcctggtggctccaaaaatcattgacacctggtgacacttaacggttctgaaaaacagatatttaactctctttttagcttatggcttctcatatatgttaaccaaagcttttgaagaagcttaggagaggtatttaaggaagaacaggaaagagcaggattcacttaggtttgactggagtgtatttagatccacaaggatctattcctccattgatatcttggtggctggctttggattcaaccaacgcaagggagagcaagaatgaaaaggaaataaaataaaatatgactgcaggaggccgtaatgagaataatataagactaagactattctggggaaatggggaaaggcttcttgtttccttgttctctggccaagaatcaactttgaaatcctccggcgagttagtgtgacgagtatgagcgaaatgggggtgcggcagcctacccttttgtgaatatttgtaagaaacttggccagagactgaggatagatccacatatatacacacagacacacacacacacacacacaccacacatatacatcacacacaccacactacacacacacacacaccacacacactacacacacaccacacatatacatcacacacaccacgcacacaccacaaacataccacacaccccacactacacacacacaccacacatactgcacatatacatcatacacaccatgcacacatcataatcatactacacacaccacactacacacacactataaacacatcacacacactacacacaccacacatatgtcacacataccacacaaacacatcacacacaccataaacataccatacacaccacacacacacagaccacacgcacacaccaacacgctccagcggacacacactatatatgcattataaacacatcacacatactacacacataccacacatacaccacacataccctgcacacactacacacacaccacgtacacatacacactacacacataccacacacactctacacacacaccattcacacatatactatgcacacatactacacataccacacacatcacacacataccccacacacattttacacatgacatacacaccgcacactacacacacaccccatacacacacatgcactgtacacgcactgcccttatctctgagccatggagacagggagtgagtgggacagtgtgtgagttattcctcctgggtgttgcaagctaacccttggttcacctcttgtaggactttgcacttcctcctgacagttgggaggcatgaggtttgttaacattctgtttgctgaccccaaaagtcctcagggagggttccaagctgcgtgggctctttgagaaatgtgttaatggtgtagctttcaatctctatgtaacatgcagtattatttgattcagatccagttaactttggtctttttaagcatttggatctggagatcactggcttcctcatggttttcagcatgcaagtagcaaagatagaaagcctttgaactgcttgttggatgcgtgctgtgggtgcctggctcatgtgcaggactaggaggaaggcagcttctctggagagagcgagaaaagttgacacaacaggaagccatctagctctccctcaccctcatttgtcattctcagtggctcctttacccatgtagacaatgctcagttcatagaccaaatacatgaatgtatatacaaacacacacatttacaacccttttaaaatcccaaacctaaacaaaacaaaacaatgaatgctacccattctggaacccctttacaccaccttcttgttatagggtaatacctctgacagagttgaaatatatataatattattcagatgtgcagagaaatggaacatccctattttctatgatcaaacgagtcattttctaaagtccccttaccactggaaagtcaggcaagggtgagaaagaggagggtgtgggtagcacttaaatttgttaacgttgtgtcatttcttctggtttaagatgtctttggctagctcagtctctttggggttcctgccttgccctctgctcctccttaagattgtgtctgaatatatgagcaaggcttatgtgactgcagacttggatgcgtgggaataagtccttgtgttgccctctgtcttccctgaactgtctggtgtggtctgatccccctctgccatctgccatggggcagctggctttgcctgtgctttgggccacagcttatgctccagttgtttgtccatggtcctgaagttcctctgtgaatggaagctgcttcatcctcatcccaggcctggtcccgtctcacagctgtatcctcgcccctgactttgagggcacagggaaatttctggatccctgtgtgctacattcacctgcatagagctcacatgaggagctgcaccaggccaccctctgccagcacattgttaggacttccatgccaccatagagttggtgcttagtggaacatgaggcttcccctagactagtggtccctagcctttttggcaccagggaccggtttcatggaagacaatttttccatggacagggggtggggttgggagttgggggatggtttcaggatgaaaccgttctacctcatatcatcaggcattagttagattctcataaggagtgagcaacctagatccctcacaagcacagttcacagtagggttcagctcctatgagaatctaatgctgctgctgttctgaggcaggggtaggggtgggggcggggagctcaggcggtaatgctcgctcacctgctgctcacctcctgctgtgtggcccagttcctaacaggccatggacccgtaccttgcccagcggttgaggaatcctgctagactacagcctggcaacctcccccggacttgctgtacctggtgaaataggctaccagccagatgaccttggtgcatgggacccatccgcatgtttgtaccgctctatcaagaacactgacatcagaattctttgctttaccttcctttcattccctccccatccctgcccccatatttacttgttagaagtgatcagctttttcctacttcttgtctggtagagactgccttcctaggaagcgctagaccttcctttgatatataaaggtaatttaagaagttgccctcctctcacaaaaatgcctgcttcttaagactatgatctttccagaggctcaacaaagaagttagtataagcctcagagctgaacatggcccttagtctaaaattgctcttagttcttagttgtgcatgtgtgtttgtgtgtgtgtgtttgtgtgtgtgtgcatgtgtgtgtttgtgtgtgtgtgcatgtgtgtgtgcatgtgtgtttgtgtgtgtgcatgtgtgtgtgcatgtgtgtttgtgtgtgtttgtgtgtgtgcgcatgtgtgtttgtgtgtgtgtttgtgtgtgtgtttgtgtgtgcgtgtgtttgtgtgcgtgtgtgtgcatgtgtgtgtgcatgtgtgtgtgtgcgtgtgtgtgtgtgcgtgtgtgtgtgtgtgtgtatgtttaggatcaaccccttggtcatctagtgaagtctatgggctgattctcaaaacaatgtttgtaaatgcacaaataaaataaatagcattacaaagataccaaaatatactgaaatgaaatcatcaaaatattaatgaaatcatcaaaatattaaagaaacaaatttgtgatctggtaatatgtggtcttctttattaacacattaaataagaagacctaataattgccttaatttaggtctaatattaataattaccttaattcagaaatagtgataatagtatttcatatttgtattagtccattttcacgctgctgataaagacatacgcgagactgggaagaaaaagaggtttaattagacttacagttccaatggctggggaggcctcagaatcatggtgggaggcaaaaggcacttcctacatggctgcagcaagagaaaatgagaaagaagtaaaagcgcaaacccctgataaacccgtcagatctcgtgggttatttacttatttactatcatgagaatagcacaggaaaaaccagcttccatgattcaattacctccccctgggtcctcccacaacacatgggaattctgggagatacaattcaagttaagatttgggtgggggcacaaccaaaccatataaatattttaaggtacctgcagcaacgaaaatataatatgaaaatatttgtgatttataatggtgacaaagtcacaggcaatgatgctattactgtagtttgttgattacacttatgatggaaggaaatcctaaatttcaacagtaggttagtgaaaattaaagatgtaaattttccccatttaagttcatggacccctgaattctacccatggaccccttaaagatctaggtccctgttctagatggtagtatctggtttccctatgaaagtgtggatgctatggggtggggagctctcaggagcaagatttctaagatatgaagatacagttgaagatatttcataaatttctctattgtacaatcttctggaaaagaaaattgttgatacatatggttgaagtgtggcatggttgtattcttgcttatgcccacatcatctgttacccatgaattatccagagtgattctaccatttgatgctttactgagtatatcacaaatactttgtatgtatttcttggtgttttaaaaatgcttgctgctcaaatgttacatttaagtaagaatgtaaaaagggatttcttaaaaagtagaaatctagctcttgaaagggaataattaaagagatgaagttagattctttccattgaacctgattgctaggttacacctagcaactaaccaaaaaaatctagcttttgatcagcatattttccattaaaaatgttcaatgctggcaatatttattgtgtactgaaatttttgtgtttgtgtgtgtgtgtgtttaatttatttagctctgccagctaagcctgagaacatttcctgtgtctactactataggaaaaatttaacctgcacttggagtccaggaaaggaaaccagttatacccagtacacagttaagagaacttagtaagtacaggagcttgtgttttatcagtcagggcatgggggaggcagaggcttctgattcattcatgattcacatcccatatgaagcaaaaagtttcctcaatgacagcttctgggtgattactgtgtgcagccagtggcttgtggacgggatctggagctgcagagggaggggaggcatagccagtgttgacctcctcctggattccccattggctgagatgagtcaccagttataagcacagtggaaaaatctgtttatttactacactcaactataccctgcctctttccagaatgtgttatataaaactgttcattctttctggatccagatatagtaagtaaggttgtaaacccagaactaacaggcaattgaccatggtctgccactaatttgctgtgtgacctctgtcaaacactattccacaggacaatgattccccaattttttttactacctcaagcatccctctttattccaattctgtagaatgaaaattttataatttttaattattattctagccaaaagctagatgttttaagtaaatatttgcaggttaaaaaaaaacttttttttgagacagaatctcactctgtcccccaggctggagtgcagtggtgtgatctcagctcactacaacctccatctcccaggttcaagcgattctcctgcctcagcctcccaagtagctggaattatgggtgcacaccaccatacctggccaacttttgtatttttagtagagacagggtttcaccatgttggccaggctggtctcgaactccggacttcaagtgatccgcccacctcagctcccaaaagtgctgggattacaggcatgagccaccgtgcctgtcctttttaacaaaaatttttaacatagctcattacttccttcttgtgaataatgaataagggggcccatgttgggaagcattgtaagatgacctttagtctttttcatttcaaaacagtctgtgattccaaattctttatttttaagctaaatctcacattgcaagggaagtccactttatgttttcagtggaagaaatgaaaaaaacaagcagtattctcagcagcactgatatagctacgagaacctatgtcagagagatgctttaaaacaggagtcagcaaatttctcttctaaagggccagatggtaaatatagtaatattaagaaggagatcggtctctgtcagaacttttcaacactactgttatagcactcatacagctataggcaatatataaaccaatgggtgcggctgctttccaacgaaactttatccatggacactgaaatgtgaatattatataattttcacacgccccaaagtatttttgttcgttttatttatttttcaaccattaacagcatgtaaatagtcttaagcctacaggctgtgcaagatcaagagatgggctatatttgacctacaggctgtcgtttgcttatccctgttttagaaaataagcatgataaaggcccaataacccatgatccaaatgacttttcttccagatttgtcagttctagtcccagtgttgaatatcaattgctagtagaatgagaatctgggcacctttataggtttactgctatttttctgtcttatagagacatttcccctcttcctccatctttccctttgggttgttattattatcaccagttggacatggagaaatagaaaacacctgggaatccccaggcctatacccagctccccttgatggcctcaggccagctaggctgtctagaactcctaggccacttgcatttttgtgaatttatcaccaagaggatctcttccaagcaaagtggaagggtttccctgtggatggcctacctgggagcacttttcagtaggtcatggaataagccaaaaaccttctgatgtccagaaacaataggaaagaatttttcctggggagttggggatgccttcatggagataatgatttttgaactgaggctgaaaggaggtctagaggtgtggaaaaggagagaaagtttatttctcaaaggtcacagcatgaataaatgcagaaatattcaactacaattatagtaataacagctcacatttattgactctgtgctggacattttaaaagtgccttatgtgtattagctcatttcatcctcataaccctatgctacagatatattactgtcttcattttacagatgagaaaactaaggcacagagaggttaaagaacttgcccaagtcacacagttaataggggcaaagccacgattcaaacctggtctgattctagaacctgtgcttataaccacgacacattgccctggaggccatttttgtgctgtaaaataaccatcaaccactcttgaggtcctttctagtttcaaaattccatgattctatgtgtctatgtctccctgtatgtattccatgtgtatatgtcttcccacacaccagcaaacactggtaccttgcaaggtgggccttcttttctgttctcagcctgctttatctcctccacaacccccagaaccatgtggactatagctagaaccacccatctgattcccactaatatgtgtatttgttttcattaagttacagcttggtagtatatatctaatctatcatctatctatctgttttaaagatttttctgaaaacaatatataccaatgttcaaaaattcaacctgaaaaattataaagaatgtaaaaagttacccagaatcccactgccaagggtaacagcttgaacattttgatgatctctctagatatctccacaaagttatgtaaatatctttatgtttatgtaactgtgatcattctatacatgatatgcatcctactttttttcaccagcagtagatgcatctttccatatcaataaatacagtatgttaaaaaccatcacttacattctatttatgtatctaccataatgtatttaacaaatccttacatatatgaatatatttttacatatatatgtaaaagaataaatttttaaggctagaatctggagttttcagggacctactcatgatttcttgcaactatagcttttcatgctatataggacatgcattgcaactatagcttttcatgacttacagggatccaaagaggttttcatggctcctaaagcatctcaggcagcagaaagcaggtaacctttacctttccttggaggtgaggaaggaatttggaaagaggataaccaaatatcctggactatacagttctcaagaaaacccagagaaaaactaacaaattactgcttaatacattaaatatggttatgtttccaaaccattgtactaaactcatgttgaatcactttttctttcaaagcgcttttggagaaaaacatgataattgtacaaccaatagttctacaagtgaaaatcgtgcttcgtgctcttttttccttccaagaataacgatcccagataattataccattgaggtggaagctgaaaatggagatggtgtaattaaatctcatatgacatactggagattagagaacataggtaagtgttatttgatactcttatatactctttattaaatgtttacctccttctctgttcaagaggtatctgtggactcaaaagtaggctcatcaagttcaaggatatgtgttgtgggtatacagaaaattcatcttctaattaaagaagaaaggaagtgggggaaggagggaaggaaggaagggagggagggagggagggattcaccaaatgggaaaaaaggaatgagaaacaaaagctattttgtgggccactggtttcctcttgtagtttgtaattgcactcaaagaaacaaaaaggtctctccccaccaccccaccctgccaatgtcattgctcataaacgaaaagagcataaaattattattttttaaaatgcctcaccacttctgacttaaaaaaaaatctttttcaaagactaattttcaccatatacttttaaaattataactgtattgagatataattcacattatataaatttcacctttttaaaatgtacagttcagtgatttttattgtattcacaaagttgtacatatgttaccactgtctaatttcagaacatttttattgccctcaaaagaaaattcatacccattagcagtcagtcctcaatcctttgttttctctttcctccattctctggcaaccactaatctattttctgcctgtatggatttgcctatacattttataaaaatataatatgtggtctttttatctaatttctttcacttagcataatgttttcaaggttcatcaatgttgtagcatgtattagtgctttaattctttttatagctaaataatattccactggatgtatataccacattttgtttacccatacatcagtttatggacatttggcttgttgctaccttttgattattatgaataatgttgctgtgaatatttgtatacaattttttgtgtggacatgtttcaattctcttagatatatacctagtgaaattgctgagtcacatggtaactcaatgtttaacttttggtagaactgctaaactttatcaaagtgactgcaccatttaacattcccactggcaatttataaaggttacaatttctgcataccctcaccaacacttgttattgtccatctttttttaattatagccatcctagtgggtgtgaagtgataccttgttatggttctgatttgcatttatccaatgtctaatgatattgaacatttttcatgtgtttattggccatttgtatatcttctctggagaaatgcttattcaaatcctttgcctatttataattgagttgtctttattgttgagttttaagaattgtttatatattcttggcacaagttccttatcagatatgtaatttgcaaatatttcctccctgtttgtgggttttcttttactttttaaatggttaaggtagaaaaatatttatatgaagtcaaaaatgtatatattttttatttgattgtttgtactttaggtgtcatatctaagaaaccattgcctaacctgaggtcagaaagatttactgctgtagttttttctaagagttttgaagtcttagttcctacatttgaattattgatccattttgagttaatttttgtatatggtgttaaataggggtctaactttattcttttgcatgtggatatccagttatctcagaatcatttgttgaaaagatgatttctgaccccatggccccatcccacgttgttgaattgtcttggcacctttgtaaaaatcaattatttcaccataaatgtaaggtatttttcagggtcttcaattctattccattgaactatatttttgtaattaggccaataccacactgtcttgattactgtagccttataataagttttgaaattgggaaagtgagtcctccaactgtgttctttttcaagattgttttagctgttgggtcccttgcatttccatataatattttagtattagcttgtcaatttctgcagagaagtcagctgtgatttcaatacggatattgtcatcttcataataaacaatcttccaatccatgaacatggaatatctttccatttatttaggctgccttcagtttctttcattaatttgttacagtttccagtgcagaagttgtacatttctttggttcagtttattccaaagtattttattcttttaaatgctattgtaaatggaattgctttcttaattttattttcagattgttcattgttagtgtatataaatacaattgatttttgtatatcgatttggtaattggcaaccttgttgaacttgtttattggttctaataggttttttaggtggattccttaggattgtctgtatacaaggtcatgtcatctgcaaacataatcttatttcttcctttatgatctggatacgttttatttttcttgactagttgccttgtctagaacttttagtatagtgttgaatagaagtgttgaaagcagacatccttttcttgttcctgatcttagggggaaagcatctagtctttcaccatttaagtttgatgttagtttagctatgggtttggtagatacccattgcacattgagaaaatttccttccactcatagtttgttgagcatttccttattgtgaataggtgtgggatcttgtcacatgccttttctttatctggtgggatgatcatatggttttgtcttttattaaaatggtgtcttacattgactggttttcataagttaaacaaaccttgtatttctgtaataaattccacttggttgtggtgtataattctttttatatgtcgctgaatttggattcctggttttttattgaggatttttgctcctatattcaacatggatatggtctgtagctttcttgtgatatctttgtttttggtatcagggtaatattggcctcatagaatgagctggtaagtgtttcctcatcttctattttttggaaaagtctgtgaaagactagtgttaattatttttaaacctgtcaatagatttcctcagtgaagccatctgggcctgggctttctttgtgggaagtttttgacttggtttctttataaaactttttttttaagacctccctttggaagacttactccacactgtaaacattggtgttaattcatgatgatagacctggaaggggacaagattattcactttttctcaaaaaccttcattattactatttttactttcttaaaataaatgtattattactttagcaattaaaatattaaaaagcaaattcagttacaaagaaaactcaaaacaaaacaaagcaaactttctagtccttctttcaactagatttagtatctatttaaatattctgtaattgccactgcttaaaactttgaggaggaattttggcctaaattgatacaatactggaattataaaattaaactctgaagaaactctgtttttataatatgtttctaggacctggtaaagtgttgctaagtactaagattttttttaatcctttaatgaaagcatttaatatcagaataataagcataataattttataataattaggttagtacaaaagtaattgtggtttttgccattactttcaatagaacttttcttatttaaattcaagtggatagaactatgacagtgcttttaagagcaattaaaaatattttgggctggcgcggtggctcatgcctgtaatcccagcactttgggaggctgaggcgggcaaatcatgaggtcaagagattgagaccatcctggccaacatggtgaaaccccgtctctactaaaaatacaaaaattagctgggcatggtggtgcgcacctgtagtcccagctactcgggaggctgaggcaggaaaatcacttgcactcgggaagcagaggttgcagtgagccgagatcatgccactacactccagcctggtaacagagcaagattccatctcaaaaaatatatatattttgatctctaattgagatacgtccttcctacccccagtttacagtgataatttgcttaaacctttttcacagataatgccggagtttactttggtccagcctctgacataaattattacagttagtggtatctaaataaataaactttagctatgtttgatatgcatcagtttttgacttaaaatgtattctgtctgattttagtatgcccaccctgctctcttttgtttactatttgcatggaacatcttttttcatcctttcactttcaatctatttgtattttcagatctaaagttagtctttgtagatagcatatagttagatctttttttaatttaaattttttattttattttttatagagacttgctatgttactcaggctggtcttgaacttctggcctcaaatgaaccctctgctttggcctcccaaaatgttgagattaccagcataagcccttgtgcccagccagttggatttttttttctttaattatctgctgatctgtgtatttgggttggagagtttaacctatttacatttaaagtaattgttgataaggaaggacttacttttgacatttaaaattttttcttttatattttatagcttttttatccctctttttttcattattgtcttcttttgtgtttagttgatttctttgtggtgacgtgttttgatttcctttggtgtattttctatagatactttctttgagattaccatggggactacaaatagcatctaaagttataacaatctaatttgaaatgatatcaacttaacttcaattgcatataaaactctactcctacacagcttcattccccatccccattttatgtcattgatgtcacaaattacatctgtatccactgtataccataaagctataattgtttttcatacattagtcttttaaattctttggaaaataaaaagaggaattataaaccataattacaataatactagcttttatatttgcttgtgtatttatactagagatctttatatcttcatctggctccaagttaatgtctagtgtcctttcatttcaacctgaaggactccttttagcatttcttatagggcaggcctattggtaatgaactctctcaacttttatttattttggaatgtcttaatttctccctcatttttgaagaatagttttgccaggtatgtaattctcagttgacaattttttttctctttcagcactttaaatgtattatcccactgccttctgggctctaaggtttttgctgatcttagttgaagatccattgtatgtgatgagttgtatctctcttgctgcttccaagatactgtctttgtctttctggggtttggttgtaatgtgtcttagtgtgggtctctttgggtttatcctacttggtattcactgggattcttggatttgtagatttgtgtatttcatcacatttggggactttttagctactatttcttcaaataatctctccaccacttcctctctctcttctctttcagaaactcccaaaatgtgtttattggttggcttgatcctgttccacagctcccttagactctgtttatttttccttatattttttctttctgttcctcagactcaatactttcagttgttctatcttcacatttactgattgtttcttatgcctgcttaagtttactgctgaacccctgtagtgaatttgtatttcaggtactgtgattttcaacttcagagtttctgtttgcttcttttaaaaaaataatttatatatttttgttgatattctcattttgttcatgtattattttcctgatttcctttagttatttgtccatgtttaactttagctctttgaacatatttaaggtgatcattttagggtcttggtctagaaattctgatggctgggcttcctcaaggacagtttctgtggatttgttttgtttacttaaatgggccatgttttcctgtttctttgtatgccttgcaatttttgttgttgttgttaaaaattgggcattggaaaaaacagctacctctccacgtctttgcagactgactctgtgctggggctgttcttcatagattagctgggcttactctgagcctagggatcagcccaaggtgaaaacttaaagtcttctcagttcttttctgagtatacatcttgtgtaggcctggctggtgctttctcagttacactgtatatacacacagctgcttttttttcttctttttttgagacagggtctggctctgttgcccaggctggagttcagtgatgccatcatagctcatggcaacctccccttcctggtctcaagccattctcccacctcagcctcccaagtggctgggactacaggcacacaccacacctggctactttttatatttttttgtagaggtggcatttcaccatgctgcccaggccagtttcaaacttctgagctcaagtgatctgcttgcctcagcctttcaaagtgttgggattacaggtgtgagccactatgcccggccacagctgcttttgaatgtcttaatttcccaaagagtcttacccagtttctccttatgattttatataatttattgtatgtctgcatacataatctcttgccccaggcttccatgtgtctgtagtctccctgtagcttttatgagcagtgcctggctcttttcctgcctgagattaaagttaggcaaaacagagaccagtcgtttagtctgccctcagacaggctggaatataagtaagtgtgctctgttctctttagttggtagaagggaaataggacctgagatgccaccttcttcaaaccaagaccactgatgtttcagggagagggtggggcaagggcaagtaagacagccacaaaactattttcctgccactttgaaggtgactttgtcttgatttggtgtttataatggttataaaccttgggttgatttccagagctcctacaagtttagttcagccagtttctgtcctttttttttttttttttttttttttgagatggagtgttgctctatcacccaggctggagtgctgtggcgcgatcttggctcaatgcaacctccgcctcccaggttcaagcgattctcctgcctcagcctcccaggcagctgggactacaggcacgcaccaccatacccagctatttttgtatttttagtagagacagggtttcaccatgttggccaggatggtcttgatctcctcactttgtgatccacctgcctcagcctcccaaagtgctgggattacaggcatgagcctccaagcccagtccagtcttttttttttttttttcaatgttttcatgggagaacaagaacttagagctacctagtctgccattttgctgatgtcacttgatataaatcagttcttaatgagatattctgagagctatttttattcagaggaataactaatactttctatctccttggttatagagtattagagttaagtggaactacagtaggtatttgtgtttattctgactggaggtggttagtgtaatgaacaagggcagaaactttggtgtggatacaaatgagtcttagattggcttcttattagaaagttattttcccttttccaataccagttttatcttctgtagaatggatataataaatgttaggtggttgagaggattcaacaaaatgattcacctaaaaaaatacttatcaagtgctcaatacatataaataattttatggaaatacttaatatgtctattgtatacagctctacttactagtggccacacggattgatgaccaccctttagtccaggcatcagtacaaattattttttgagtagctaccaagagttttctgaatatttttacccagttaatgttttaaagtccatgtctctaagtagggattttgctttctaaaactcttcaagaattacaaagaccccattctccatgatgtgattattttacattgcatgcctgtatcaaaacagctcatatgtcccataaatatacacaccaactatgtactcaaaaaattaaaaattttaaaaattaaaaaaagaattacaaagactaaaaagataatactattcaattctagctagcaagagtctggtgagatgggtattcatacaatgttgatggaaactgaaattggtataacctttctggaaagctaaatggcactgtgtgacagcagccctaaacatggtcatgcccttttacccagtcagcctctgctaaggggtctagggaaaccaccagagatgtaaaggaaaattcaaccatcatccatttactcattcacttaacaaatatttgatacctgctaaatgtcaggtgttaattctagactctgtgatcaagaccagcctttgtcctcaaggagttttaaatgaaaaattagaaacactattgttagcggtggaagttatctgagttaccagcagcaaatccgtatgggtctgcagcaacctcagttcttgcctcctcggaagaaagaattcaactgaggggcatacgacagaagaagaaactgaggcacgttttagagcaggagtggaagtttattaaaaagctttagaggccgggcgcggtggctcatgcctgtaatctcagcactttgggagcctgaggcgggcggatcacgaggtcaggagcttgagaccgtcttggctaacatggtgaaaccttgtctctactaaaaatacaaaaaattagctgggcgtggtggcagatgcctgtagtcccagctactaggggggctgaggcaggagaatggcgtgaacccggaaggcggagcttgcagtgagccgagatcgcgccactgcactccagcgtgggtgacagagcaaggctccatctcaaaaaaaaaaagaaaaagataaagaaaaagaaaaaaaagctttagagcaggaatggaaagaaggaagaaggtaaagaacacttggaagagggccaagtgggcatcctggaggtcaagtgccccgtttgaccttggacttttctgcgccttgggttttctacgccggcctacttccggcaccttgcgtcccatttcccttgattcttcccttacggtgagctgcccacttgcacggcggcctgctagaacttaggaggtgagcatgcgcagtgtatttactggagtcgtacgcatgctcaactgaggcgttcttcccttttccattggaatgcccccagaagctcatataccagttaaactctgccattttgcctcttaatggccatgcttgagcccactcgcccagttcctgagatttttttttttttttttttttttttttttgagacagagtctcactgtgtcgcccaggctggagtgtggtggtgcaatctgccacctctgcctactgggttcaagtgattttcctgcctcctgagtagctgggattattggcgcccgccaccatgcccggctaatttttgtatttttagtagagatggggtttcactatgttggccaggctggtcttgaacccctgacctcctgatctgcctgcctcagcctcccaaagtgctgggattacagatgtgagccactgcgtccagcccaattcctgagatcttactggggagctgccaatcaccagttacaggtgtttttatatattgggaaactgcctttccctggtgctggctacagccaattattaggtttgcaaggcagcgtgacaatggtctgagcatcacctgatggtcacctgactttcctggtggggtgtagggggagccctctcctgtccttctcatgcctgattagctacctactgtaataccatgaatgtgcgataatagaacataagtcaaaaaattatgttcattcataaagtagaatattatgaaccttaaaaatcatgttttgaagaattattaatacaaagggatatatgctgattgcataatgttatttttaaaaaacaaaagctttatttagcgtaataccaattttgttagaagataatgcaaataattatacggaaaacggctgaaaggaaatataacaaaatggtaataagggttatctctggttgatgggataatggatgatttttagtttttctttgtatttttctacacttaaaaaatgttgtataataagcatatgctacatttataactagaaaaatgcatattttcaaagagagaaatttaaggctaaaatgtttgcagtgtgcaaggaaaatgagagttattttctagtgtttatagtgggtattccatcatcctaggggtcaaggaaggagaggcctaggggaggtgagagtaaataagagagacagcctattttctggttgtgtggtctctttttacctcccttctgcttggcatagcatatgaccaatcaataagaggctgatttgctgaaaaatcacaggaatgcatccttctctcactgggtattcctttttcagaggtgttggggttgggggggtgacattccttttgtactgccttgcaaatgccatcttcgttccatatagcagaccacaatgcacgtatcattttttttcaattttgggtggatgctattagcaaattcttatctttttgcagatatgagagttgtatgatttttattttcagcgaaaactgaaccacctaagattttccgtgtgaaaccagttttgggcatcaaacgaatgattcaaattgaatggataaagcctgagttggcgcctgtttcatctgatttaaaatacacacttcgattcaggacagtcaacagtaccagctgggtaagttatgccattataataatattccaattagaggcccagaggaaaagaatcattgacaactattgttgacctggaatcattatttcactttttacattaaaaatagaagagagacattgctaagtacttctccttccagttttccatttttccatctggaccttttagattggaagggtgttctacaataggcatttttgccttctgagcacagggacataataaagagtgagaaatttacttctgcattatatccaagtttgtgtctggctatgttggctaccagagagtctatggtttggccattttattttttatttttctgaccttttataaaatcatgaggtataacatacatttggaaaggtgaacaaaacgtaatattacatttaacaaattattattaagtcagtgctcatgtagaaaccactgcggccaagaatagaacttctccaggatgccagagccccctgcttaccctttgctcatgacctctgttagagctgttaccctgattttcatggtaatcttctttgctttcattttttaccatttaaggctgcatcactgaagaacatagtttaagagactatgccctgtttccttgagtcccaggatgaagaagcgcccagtagaaatagaggaggagcatataaagggaatccatatattttgtattttctaatgtttggcttctatctctcaatattgtgcttttaagacttattcatgctatataatgctgtagtttatacattttcattgctgtgtagtatctcatagtatgaacatgatggaatggtggctttaatttgcatttacctgacctttaatgaagttacacaccttttcacatgtttattggccctttggattccttcttctggaagcgctgatttaagccttttgcatgttttttctattggctggtctgcctgatttttcaattgatttgtaggcattccttacatattctatttatgagtcttttatttgttacgtgtattgcaaacatctttcactatgtggcatgacgtttcactctcttaatggtgacttttgaggaatagtcacttaattttaatatggttagagttttatcagtctttacctttatgcttaatgccttttgtgtcttaggaaatgttttcttacctcaaagtcaagaaaatattctgcagtttccatcaatgcagcctgaaattgtatcacctttttgtaatcatctcatatttattgcctttttataaattttagacagggtctcactctgttacccaggctggagtgcagtggtgtgattgcagctcattgcagccttgaactcttgggctcaaacgatcctcctgcctcagcctctcgagcagctaggactacaggcatatgccaccatgcctggctgatttttaaattttttttgtagtgttgcccaggttggtctggaactcctggtcttaagtgatcctcctctctcagcctcccaaagttctgagattacaggtgtgagccatcatgagcagacacattattgacttttaatcaactattagccaattaaatctttaagactttttacctcctgaagacttgccagtaaaacatacctctactatcttatcatttgttggtttttaacctaagttcaggtgttttatttattcttattgaatgtcttcatgttggtcttatctatcattccagcctatttagaatcctgtttggtcacccaaaacttatgattaactttttactttttaacttttcagtatccccagatttgataacacttccttctatacctttatctaattattaataaaaatggtgactacatcagagccctgtggtaaaccagtagaaaccatccagaggatcaacccctcctttggatatggtcatttattcaggtttctatgaatatacctaattaccactatcatcattcagcctacttttttttatcttgtccaggaggctatcatgcgaccctttcccttgtggaaacccatagacaccctgtttactgcagcatgctctccttgtctggaactctttcagaaaagcattatttgtcctattgttgcagaatttttgctccttagttcagctaaatccgggttcttgtgtcaacaggaaaaattaggcacgtggacacattgaagggtgaggagagaggaatttattgggcgaaaaggaaaaaagagaaaaaaattctcagcaaagcgagatgggctcctgctaacaggctaccacctcacagactgaataccaggccaccacacaggagctaaagaggccaggctccttccccctgcacaaagcgtgaacttcccgtggctccaccccattctcccagtgcacaggcgggtccccagtctgttgtcgacatgcgcggacaagaccctgggcaggtttcctcatctacacaaaagcatctgatgtaaacacttgggcgggtcagagattctctgggaaccccccttatctgccttctgcctctatcactgtgttcagagagatgataatggccacttctccccccagcttcctttctaagccagctctggaaccattctctttgaacctgcctacatggaacattagattcattaattgtagtttggggaacccctaagcagagcagtccccggtatagcacaagctcctcttcataccacatgtcatggtctccgtgaacctgagaaacttctgggatagtctactggctataaacccttaattccttctatttggctgagtgcagagttactacagctgctgggggataggattcaacaagaaaaataaaccaggaccagagtccctctggaaaattactataccgcatataacactaagtgagggcaacgggtataaactacccaacccttggcatcctgtaccccgtatctttaacaaactcacccacatctgtactcatctttgcttcctgccagtcccagaggtaaaatgtcctgcctcctgttttcctggaggatgcaggaaggaaggtggaagtctgtactactctttctctctccttagctagcttgcttgcttgcttgcttgctttttttttttttttttttttttgaggtggagtttcactcttgttgcccaggctggagtgaatggcatgatcttggctcactgcaacctccacctccggggttcaagtgattctcctgcctcagcctcccaagtagctgcgattacaggcttgtgccaccacacctggctaattttttgtatttttagtagagatggggtttcacatgttggtcaggctggtctcgaacccctgacctcaggtgatccacctgcctcagcctcccaaagtgttgggattatgggcataagccaccatgcctggccttctccttagctttcaaatacaagcagttatcctcagttgcaatcccagctaaacccaactctgctcttcccaaccttctatcaaagatttccattgttgatggaaaagggtccaaattattaactctgtgagacctggcatctaccgatcccttcacgctcttgctcttgcctctctggtcattctgaattgcttgtttcccttgcatcatgttctctcactctttctgtgcctttcctagaacaccctctgcttttgcacctctcctgccccaatctccacctttcagaactcaggcctgacatatttccttctgagggcctgggcctggtccctcctctgcatgcttctgtcattgcacttaacagcaatgcatttcaactttctcttccagttacactgtaaattcttcaaatgcagggaccttagttttcatctgttttccctttgcctggtgcatgcctgtgctcaataaatatttgtttaaatgtagccatgtaaaactaatgctaaaattccaacatgtccgtttaacaagacccatatttgtatgatattatgagtaacaaagagcttccttatactccaaattatttaatccttgcaaatatcctgtaattgaggccttgctatccccatttttgcagattaggaaatcaagatgttgaaagcttaaatcatctattcaagatcacagggcttgtcagttgcaaacctaagctcaggttttctgtctcccaggtttgccatccatgtgaccttacctcaacaccctccagattcttttgtggccctagtctaaagggtttgcacctttgtataataaagccatgtgagcctcttagaaagggatctcaaaagtattttaagaatttgatttatggactgggtgcagtggctcacgcctgtaatcccagcactttgggaggccgaggtgggtggatcacctgagatcaggagttagggaccagcctggccaacatagtgaaaccctgtctctacgaaaaatacaaaaaaattagccgggaatggccgggcacggtggctcacgcctgtaatctcagcactttgggaggctgaggcgggtggatcacaaggttaggagatcgagaccatcctggccaacacggtgaaaccccgtccctctaaaaatacaaaaaattagccgggcgtgttggcaggcacctgtagtcccagctactcgggaggctgaggcaggagaatggcatgaacccaggaggtggagcttgcagtgagccgagatcgccaccgtactccagcctgggtgacagagcaagactctgtctcaaaaaaaaaaagaaaaaattagcccggcgtggtggtgcggacctgtagccccagctactggggaggctgaggcaggagaatcgcttgaacccgggaggcagaggttgcagtgagccaagatcgtgccactgcactccagcctgggcaacagagtcagggaaaaaaaaaaaaacaaaaaaccacacacacagaatttgatttaggttttgtatcagaacttctgactcatctattaagacaaacactttgggtgagttaggatttggcacaaagcatagattgttaacagtgaacatgatgaagctaattaatgttttagtagggttccattgcctgtgcagagttggggaagttttggatctaagcctgtatataaaggatcaattgatcctggatcctgtcggagccagaggcaccttggctggacaaaataacaaagtaaaggagccttacaggcaccttgattaaaagactgagcagccgtttcatcttctctgaggccggggctgggaggaagaggcttccgtggctacattaggcagaactttctgtgtaatgtacgtgatgagaaccactacacaggctgagcatgtgctaagggtacaacaaagcaggaggaaaaattgaaaggttaaaaagaagaatattatatattttttaaagcatgacaagtaaaatagaggtttattagacttccttacacttgctgtatggattagtatttttattttaaatcacatatggagggcaccatgtggttgggcctttcctggcagtcttaatcctgttctagttggatccctaactaacaacaggctgtctcaagttactctctccacaaccctagtctgccatcacagcatctccggggcctgtttgaagaggatgctcagggaacctgggatttagcccccaaagtgtcattgcctcttcttgttccacctccatctcaccaggctgggagttccaaagtccatctgcggctgtcagctttctgccatagacacatatcctccttctgcccaatttccttaaagcacaggagctgcaattaggtactaattttcacagctgggacatagatgcaagtagtatcaggacttccttctcttgcaggatccatgggacgatgctgtgtgcatactagttaaatagacatgcctattagtgcagtttatttttttattaatcagctcaaaataagctttataaacctttaggctttgggttttataaactttaggtttataaagctaatattgagctaaatgtttatattgaactaaaggtttatattgcagcaacaatgactgtgctcagaaaaggaatagctaaatgtttagtttctcttggagagctgagtcccagaaattatataaagcaacaccttcactttaccaatgagaagctgacatctagagaaaataactgattttatttacctctttcctccccaagagagtatcaaaattaatttatacattcaggccattgagactttcagcagcttgactggtcacccaaagaccagtgctttgaagtgaaagatttgggtaaaacgaaaaagccgaggagtgaagaaatctgtgttctgatcctattctgtagatcttctaactttcatttaaatggttatttaactttcctgggtctcgtggatgacgtgaggattgcatttgatgcagctaaggtctctgtttctgctgttccatgaggcagtatctctaggtgttggagtcacctcctaggcccaggttgccctgggtcatgaggcttgcgtcttctagaacagcaagcagcagagctctgctcacccagaccaggccagaggcaggaatctctgccccataagcttagatacaggaaatgggaagggagttggtggttcatggggatgttcatatctgtgtaggtaccaattgttcccaggcacatatggaagtctgttaataaaaatgatatattttaaaatttgatttagagtgttactagttctaaaaatgtaaaagtacactaggtagtgaagaggaaaatgggaggataacgtgtggtctccatttcagtttaggattgtctctgtcttgtagatggaagtcaacttcgctaagaaccgtaaggataaaaaccaaacgtacaacctcacggggctgcagccttttacagaatatgtcatagctctgcgatgtgcggtcaaggagtcaaagttctggagtgactggagccaagaaaaaatgggaatgactgaggaagaaggcaagctactccctgcgattcccgtcctgtctgctctggtgtagggctgctttgggctagacttggtggggtttgtcaccacctggttgggaatcatggaatctcatgaccccaggggccccctgtaccatcgagagtgagcctgcacaactttgtgccccaaaggcaaaggatcacattttaatactcatgaggttcttatactatacatgaaagggtatcatatcatttgttttgttttgttttgtttttgagatggagtcttactctgtcacccaggatggagtgcagtgatgtgatctcggctcactgccaccaccacctcccgagttcaagcaattcttgtgcctcagcctcccaagtagctgggattacaggggcccacgaccatgcccggttgatttttgtatttttagtagagaagggatatcaccatgttggctaggctagtcttgaactcctgacctcaggtaatctgcccaccttgacctcccaaagtgttgggattacaggcgtgagccactgtgccccgccagtatcatatcatctgaaggtatcctgtgataaattaaagatacatattgtgaatcctggagctactactcaaaaaataaataaaggtgtaactaatacaatttaaaaaatcacatttttaatgacagtgaggaaaggaaagaggcatggattgcaggttgatggagtgcttactaagtgtcagtatggtcattaagagcaacgcttccagtcagtggccttggcttaaatcccaagccaggtgtctttgggcaagatacctaaactctcagttcattctcagcagtttcctcgcatttattccccttttctatattgaaatagaatatgtaagttgagtttatagtagtacctattttttagtattattttaaagattaaatgaaataatgtgtttagcccatagtagatattcactaactgctagacttcctattcttattatttatcctcctactattatttttaatcctccttaaagcactataaaatatgtagagtcactcccattttggaaatgaggaaactgagtttcagagatgctaataaacagctcagggtcactcagcatgtgttacttttctcaagagccttgcccagagtctgaccctcagtggacgatcaataaatgtgtgatgaatgtatcagttttctattgctgctgtaacaatacaaatttagtggcttaatgcaacactaatgtattctttcatagctctggaagtcagatgtccaaaatcagtttcactgggctaaagtcaagatgtcagcagggccatttccttctgagactctgagtggagaatctgtttccttgccttctccagcttctagtggctgcctgcattctttggcttgtggtccttcttccatctacaatacttatccccccatcatcacatcacctttccccactcttgtgtgtcaaacctctctgcctccctcttataaggacttttgtgatcacagttaggacccacctggctaatccaagataatgttcccatctcaagatcattaacttaatcacatctgcaaagtcccttttaccatataaggaaacatttacaggttccagggatttggacaagattttttttttttttttttttttttttttttttgagatggagtctcgctttgtcgcccaggctggagtgcattggtgtgatctccgctcaccgcaagctccgcctcccaggttcacaccattctcctgcctcagcctcccgagttgctgggactacaggtgcccaccaccacgcctggctaattttttgtatttttactagagatggagtttcaccgtgttagccaggatagtcttgatctcctgacctcatgatctgcccgcctcagcctcccaaagtgctgggattacaggcatgagccactgtgcccggcctggacaagatattttgagggccatttttcagcctaacagtaaatgaatgactaattggatgaatacttggtgatggccacacatcttcttctgaatgatggacaagaaattttaaaatgcccacccttctaaccttcctctgaggctttaaccttatttatttataagggatgtgagttttagaatatgaactccccccatggccatgatttcaggcctcatgatttcaggtggtttagggatacccatattgtaatagaaaattagatttcagtctcatacccaagttgcagactggtctcagataacatctggggtcaacttctgtgctacctcatccacacaataatgatttattcctttggatcctggttgagtttccagtattaacactagtattaacagatgtttggtgcattcaccactatggtcagatgcctggaaccaatttgatgccttctgaattttgtgttccccactggagatgttcatgcagtatcatttagcaaatagttctcttcctttgcctcacttttcagcaggcaagctgatgattaagtgctcccttgggtgccattgtgttttgcctagctcttcccctgccatggctgtcactcttctttctagtgacctcctggtgccatcgtggctcagagtctcaagcttatcacagaccagccagtccctcgtgtcagttttctcagcttgttttgctgccagaaaaaagatttgctatttcatctgatttattagttcagctagcttgatttaattagcaaacacttatttatcaaagtcaccactagagaacttttgcttttgtccttcttcattttttcaggatcccagaagaaactgattaaaatgcaccccccagccaatcctcatttcttgttttcaaatttataaagcgtgtgttttcctatttcaatgaaatgccatttgtttaatgcgtaccacttcaaacctctctaattgtttcaaaacatgtattctaagttgaatgtgaagcactgcctattttattttggatttcaatatattgattattagagttacttacctatatttaggcatttaaatatctactcactacatgatacagaaataatttgattcaaatcctggctttatttcttaaacgcttatgatattgaatacctgcttaatttctctgtgcttcagaaatgatgattagtaacattattgctgtatctgattacagggctgtgggcattaaatgagaaaattcagagaaactgacacttgctaagagctagcttgtattattgttggtctctagcaggggcacctgcacatgtctaactgctgctggttgtggggatgcccatactgtcatagaaatggtatagcatcaattgttgctgcatcagtccagacaattgatgcctttgaatatgtagacattttggttgatttggaaaattttaatttttttttcagagtccttacatttccccctttgattaaactgaaaatccatgatcaatttacggttaatggaaagctggctataataactatagaagacttacatggtagtgaggcagcagtttcactaacagctgcatctgtgggaagtctatactgagaagactgtctctctttggaccatatttgcaggaaatagtggcctcaatgaaagaagaaaatatcaatttaaactcatttattattaccatctacaaaaacaaaatggctgcctatgagataattttttttttttttttttttgagacggggtctcactctgtcacccagactgaaatgtagtggtgagatctcagctcactgcagcctccgcctcccaggctcaagtgatcctcccacctcagcctcccgaatagctgggactacaggtgtgtgccaccatgcctggctgcctatgggctaaatccaagaagaatttcactcatatttctagtcaagtgcctggaatgattatttaataatcagtttagctttgcctgtatctatccttgagatgaatatttaggactgggtagtaatgaacaccttgtctttagatttttttttttttcttactctcaatattactggccttaagtttgactctccacatgattggaacagagagattctgcacgtgagagatggagtaaaggtccctctaatcctgcgggtttccttggaaggtctaatgactttgtagtcctgtacaaaggctgtcttctgggaggaacttggccactgcttacatctcactggcttgtagacagggtgaaaccagcctgttgcttcctgtctgagaaatttgagtaccggctgtcctgtcttatgattcaataaaagcctttgagaaatcagaaaactcatggcagagcttttgagacaacacctcagtgggattcagatgaaataatatgtaaagtcaacacagttcaatatccttataagcaattctaatggaattgcatttatctcattgggagatcctgggcctaacagctagactgtgttaactagactttggcttctgcaagagtagttgtagaagtgtgactctccattaaaggcaaaacaagttattaactcaattgtacttggtacattttcctcattataaggttgtctttagctggagttcagttattttacttttttaaaaacaattcttttgagacacgactcgctctgtttcccaggctggaatgcaatggcgcgatctcagctcaccacaatctccgcttcccgggttcaagcgattctcctgcctcagcctcccgtgtagctgggattacaggcacacaccaccacacccagctaattttttatatgttttggtagagacagggtttcaccattggccaggctggtctcgaactcctgacctcaagtgatccacctgcctcggcctcccaaagtgctgggattacaggcatgagccaccgtgcccagccagtaattttactttaagatatccaatcacctacagtttaaaagatccctgaagacaatctcttacttctaaaaaatagtttagatattggtctgagtggtagactcattctttgtggacctaattacattatctccagccatgctacttcctcaagaaaaaattcagagtgcaactactgcagctttgactagggacatttactctcttctccaaatcgtgggccgctagccgtctcgacatttgtttagaactctctgctttcctctcatggctaaggtgggtgggtcgttctctaatcagtagctcagcattttgatatttcaggtgcatgtcagggcattcaactataaattgccagtgagccatctcctgacaaaacttgcttgagacaggatatttgagagatacagtccagaaatcaagtgaaatgtaaattccttgttttttgtttcatccctatatggttagatcatcagaagcctgtacacttggactattgtctcagactgtgttgtttactggaaaaaggcatgtgtcaggatttatgccctggctatttatagaaaacagctatgaaaaatgcacatatatgatatttctgtgcttttgctctattgggattacagatattggcttttacgttactctctgtcctttttgaaaagatccacgtgataaattccatttatgatttcagtgttcgtaaccagaaaatagtttcccttcatatgaatttctaggtttcctttttattgggccatgggaaataggcacctcaatgtgattcttttttattttgggaaaaccagcgttaaatttagagctcaaggagggacctagtgaagcttattgtcttattcctttgtcatttaattttttcttttattttataacatctcaagtatgtggttttatttttttggaagtagacttggtataaattgtatatacatatatctccttgtgagttatctgtgtcattcccagctataatatatatgttagatctagaggacattagatagtcacattttgatctagatttgggtgacaaattatattacaatggggcctattatacttttcctttatcttacattaaatcatcagactcaagagcagttttatttttttatctttggttgattccagttccttgaccacaaaatgaagacatctttggtcattgcaaagctgccatccctccactcctcaccttattcccaatggctccctcaagcaaatccttcccaactgcccagctaacctttcctgtctcctctgcaactcccttatctctgggttgagtacctcattcttgttccttacagctccatgtggcctggaactgtggagagtcctgaaaccagctgaggcggatggaagaaggccagtgcggttgttatggaaggtgacctccctctggattctttttctctctctttcttccccttccctcctttccctcccttccctcccttccctcccttccatcccttccatcctccttcccttcccttcccttcccttccctcccctcccctcccctcccctcccttccccccaccttccccctcccctcccttcccccaccttccccctgcccactccctccctcccctccccgcctcacctttcccctccccactccctcccctcccctctccactccccttccccctccccagtccctcccctcccctccccttccctctccttcccttcccttgccttgccttgccttcccttcccttcccttcctttctctatctctctctctctttccctccctccccaccgccgcctttctttctttttggcagagtcttgctcaatcacccaggctggagtgcagtagtgaaatcataactcactgcagcctttaactcctgggctcaagtgatcctcccacttcaccttcccaagtagctgggactacagaagtgtgccagtacacccagctaattaaaaaaaaaaaaaaaatatatatatatatattttttttttttttggttgaggctgggtcttgctgtgttgtccaggctggtcttgaactcctgggctcgagagatcctcccaccttagcctcccaaagcattgggattataagcatgagccaccatgcccagcctgtttctttatactgtttaaaagcccttgatctcttacccttctaaaaactgtgattcttgaaattttacccccagaatttccttccctagagggctttatgatgccccaaatctcacattggttggccagctcaaaaaagccctataggtcatcttgcagatggcccaaacatgcatgacagacgctggtccccctcctctttggtctgaaacattaacattcggggtgggtagaaagtgaaagtgcaggaggcaccatgaccttctggaggaaacgatcactgaccagcctctgctggaaggcagcgtaagtctccggaacccccctccccacccagctgtctcagaagagctctgatcagggtcagcttgctggtgtgtcctcgagtcattggcaacatatatggcacatgtgtgttgaaatagtggggcacaaaaacagaagagggaccacatggtccttcctagggcggaggcctgggagtgaggaacaggagaagtcaggtggggaatgcagagaagaagaagagggaagaggacctgagagagggaagtgagagaaggagtagaaaatggggggacaagggaataaacagaaaaggaaaagggcagatggagaaaaaaagagtgaaaagatggggaagaagaaggaagagaggagtgagatgccagaattccttcgtgtgcctccagaattcccaggaaatgctcatgatgttagctcatatttgctgaagtccaggcaagttcaaaatcctgttgaaaatggagcaagtgtcctgctttgccagatgacattccaattacctcagggttggaggctcccgcaccatcgcccactccctccacacccgcagggctatgggactccctgggttgcggaggcggtgctgccgccgcatgggacaacagccagagatggcggggaatcctagagaatcaatcccagatgctgtgctgtctttctcagccatcaagtatgaaaacaaatgattgtggcaacacatttttgggggaggaaagccaacaacctcacacgcccacatgtggtcttagctacatagcagtggcgaagggccaagtagggcagcttgcgaagtagagaagatggatttcagtgcccgcctcctccccgtcgcctgttgggtctggtctttttctccacaccacccccccgcccccccgcaccttcaaaaggaaagagctctctaagaatttgagttggttaaaaaagaatgtactaaaatgctctaaaattaaataatagtgatagttgcatgactgaacatactattaataaaagccattgaactcacattaaaacagtgaattttatggaatgtgaattgtatctcaatttttattattttaaaaagaatgttatttaaaaaagttatttaaaatgttaatatgttattttaaaaagattttaaataacatattaatatgttattttaaaaagattttaaataacatattaatgttattttaaaaagattttaaataacatattaatatgttttttaaaaagattttaaataacatattaatatgttatttaaaaagaatatgtgttatttaaaaaagaaaatggggctgggcgtggactgggccggtaatcccagcactttgggaggccaaggcatggggatcacttgaggtcagaagttcaagaccagcttggacaacacagcaaaaccctgtctctactaaaaatacaaaaattagtcgggcatggtggtgcacacctgtaatcccagctactcgggaggctgaggcaggagaattgctggaatccaagaggcggaggttgcagtgagccaagatcaggccactgcactccagcctgggcgacagagagagactctgtctcaaaataaataaataaatacaataaaatagaaaatgggtcgtcttgagagataaaaggctcctggtcattaggaagattctagctgaccttttatgcctagacataaaagtaaaggaaattcctgaactgggaaggcagtgggacgaagtgcctgctaaagtcccacttataagtcctggacttatattcaggcattacgctccatctatgtgtataatcagtaacagaaggggaagccctataaattctgggaaatactgtctcctaggcaaatgtctggtgagtgggcccaagttcaaggctgaaaataagagtttagcttaaagtcctcaggattccaccttaaacttctcgccaagggtttgggactggcagtgcggccctcttagctaggacgcctggctggggcgcctggtccagggaagctggctcccttctcagagggagaggcatggaaataaaagactagggcatagggtactctccaacctttggatactccaggcaagagatgactcagagccagaccagactttggatgggctgagagggaatgtgtcagctttttagcccttactcctttacacgagtgggatggagcgaaagatacaggcagaaggaaataagggtggcttgtttacattgttttgggcattcttctagtttagcctcatggaattagatgaaatttagtaaatcccctcttctggcacttgaagtgttactatcacagcccaggatcttattcatccctggagggtaattacctgattgtagtttagtatctaatagttagccttattccccaccctcacccccaccgcttctcactgtctcaatgcctttctttttctttgttattggcaataaattttgttttctttgggttcagaaggcaagaggagccccagtcctagagaaaacacttggctacaacatatggtactatccagaaagcaacactaacctcacagaaacaatgaacactactaaccagcagcttgaactgcatctgggaggcgagagcttttgggtgtctatgatttcttataattctcttgggaagtctccagtggccaccctgaggattccagctattcaagaaaaatgtaagtagagcatcaacttcttccttaggtgcctggtcccatcaattggccaaggagcagtccctgtgctctcaagggtggctgtttctcttgagtcaaaatgaaaatggagtgggaaccttttaggttgtggtgaagcaatgagaatttgctggtaattaatgaatcacttgaagtcatgttcctttggaacaaagcctgcgttaaaaatcagagactttataaattacagaatacaaagccatacacctagaagttctgtgtgcagctttgatttgttctggtctgggtgaatgtaagctgggtcaagtcctatgaaactgtcctatttctcacatttgtcctccgtgaccgaagctgcccttgaactcttctccccacaaatgggtactcaccacatccccatccttggtttaatgcttgctgtcctgttttcttccttttccccttccatttgtcactatggaaaaattctagtgtttatacttgccaataaattgttcattacacttttggttaagtagtttttgacatattactgctcccaggcaaactcatatttatcctgttttggaataaaaaactttcattcaaagaattgcagacaatagatttcctcttttctctcttatttttctctttcaaacttagtactatcccttattctataaattatcttatttattttactacctttttcttcctcaataggatgtaaatgccatgaaggcagtgattttttgtctgttttcctttcttttttttaacctaattcccaacacttaaaatagcatagagcagttggcatagagcaggtgtgcagtaactatttgtggaaacatatcatagtcaggaatgttctctccaattcaccacctttctctatttgcttacacctagactggttcagacatttacacaaccagttctagaattctctgcctgtgctgccttccatctcttctccttaaaccctcattttataattcctagatatttatatttttgtattttgagctacacttgatattattttagttagcatttaatagtactccctgtagtcctcatttcctgacatcctagttcccgcctgtccaacaccctagtgatgaagttcctgacaaatgcacgtgtcattggggcacacattctttattaatagaggtgctgttaaatagtaacctcagtttcccagtgtggccccaggatgggaggtggtaaagaatagggtataaaagcatgggctttggagtccagcagccccgggttcaaatctttgctcttccacaagataccattaaccttgggcaagttacctaacttctctgaagattagctactcgtaaaatggagctattatataataatacctacctcacagagctgtagtgaagattaaatgagatcatgtatgtaaaatgctttgtctggtgctaattattactattgtcattattattattattattattattattattattattattaatttttgagatggagtttcgctcttgttgcccaggctggagtgcaatggtgtgatctcagctcaccacaacctccacctcctaggttcaagcaattatcctgcctcagcctcctgagtagctgggattacaggcatgtgccaccacaccaggctcattttgtatttttagtagcgacggggtttctccatgttggtcaggctggtctcgaactcctgacctcaggtgatccacctgcctcagcctccctaagtgctgggattacaggcgtgagccactgctcctggcttattgtcattcttaataaaatttctgattgatcaaatttctgttagacacagattatcgactttaaaaatattataaaatacactttaaagttatgctaaattcacttaggttttttttggctttgtgtcagatacgactgtgtgatcatcaattataagggtcctagatcaggtattggcacactgcagcttgcaggttaaatctggttggacacttgttattgtaaatgaagtttcactctaacacaaccacacatatttgctcacatattatttatggcttcttttgtgcaacggtggctaagttgaatagttatgacagagacgacctagcccacaaaacctaaaatctaaaatatttgctatctggctctttacagagaaactttacagatgctagtcccagacataaaagaaaataatgttctggatgtgcacgatggctcacgcctgtaatcccagcactttgaggccaagacgggtggatcgctgagttcaggagttcaagacaagtccaggcaacatagtgaaaccttgtttctacaaaaaaaaaaaaaaaaaaaatacaaaaattagccaggcctggtggcatgtgcctgtagtcccagctacttgagaggctgagggggaagaatcgcttgagccaaagaggttgaggctgcagtgagccgagattgtaccactgcactccagcctgagtgacagagcgagaccctgtctcaaaaacaaacaaaagaaagtaatattctacagaattttgcttactaaagtggaggcaactggagaatgagaataataactagagaataataagataatttttgtaagtataactatcattaagtaatagttatcatacattgtctactagtatgtgtcaggaattgtgctaagataacataggttttcccattttagccttgacatgactcatgatgtagatgctgtgagatctattttatagacggcaaagggattcaggcaagcttagtaatgtgcccaaggtctctggagtgggatgattccagctcggatctgcaggattcccaacttgtaccatatcccacaaccttagatgtgttattcataaagtgacttgaattccggtcacagatgctgtgtgacactgaactggttattgacctgtgcgggcctccacgttcccctcttggaataagggcttggaatgaggttccttctgctcagcacgccctgggttttgtgagacccgagacagcaggcagcggtggcgtggtcccaggcagggcatcggaaagcccggccactgtgtcataaggccagaggaggaagatgggcccaagttggggcagagctcaggatgggccaggacggttggcaaaggagaagcagcaccagcacgtgagccccgggtgactgtcttcatgcagatcacaagaaatcaatggctttcacagtcaaagcccctccctgcttcttcaaggaaggatctgtgtttcccaccacacctggggatgtttggagtaattgctcagaaagctcttgttgaatgatggaaggacccggcgattcgtttatattgagtagagtgatgacttggaaattccccttttggcgccccttggtgtggccaggctttcccctttcaaggttgactcatggtttcctggggccggcgccacgcccctgtggtctccgcagtctctgcagtgcacttggcgctttagacccggatctccctgctcctcagagctccagtgttggtgagaaggagtgtgggtttagacaccaacactggcttcttcaggccaggatttgtgggcaatcattttttaaaaaagtgcctccagggagatgaggaagctgcagaagcaggccaggacagggcagaggctgagatgaaggtgggctttcagggctgccaaaacgaagcactgcagactggggggcttcaaacaacagaactttattgtctcatggtcctggaggccagaagtcccacatcaaggtgctggttggccatgctccctaaagtctctaggggagaatccttccttaccccttccagcttgtagtggccccaggtattccttggcttgtggtagctccagtaactcccataaatccaatctctgcttcagtcttcacatggctagcttcttgtgtgtctctgtttccatgcccagattcctcttttcttataaagggcccactgtcttaactaattacatctgcaatggcctatttccaaatacagtcacattgtgtggcactgggtatatactttggggggatacaattcaacctgtaacaggtacaatctgagataaaagccccagggaggggggttcccactggatcttgcaggggactctatctagagtgtgagtgacatctcatagtcatcccagccaagcaaaacacaagcacacagtaagaaggaagctgagtgggtctgggtggagcgccaacattggctgctagaagagtctagttacatctccaaggctccagcagggactttcagccaggactggctgggtatgcttccaggcggtgagcaggggaaggctggaaggagaaactcagagccctagggttaggtggggtcaatctccaggctctgtgcttcttgccccggcctctgctccttctgtggcttcacatttcctccatgcctcagttgtccttctcagagttaccttttcaggttgacaacttacctggccttgctgctaggactagcccctggagtgtctcataaggaccctgtttgggaaaaggatccgtcaactgtggcttacaagaacaagactcctaaatatacacacagcctgctggggtttgttgccaaggaatagcaggatgcaggacccctggtccccaccccagattcctacatgtggcctaggcttccagcttcaaaagacttttgggtttctttttttttttttttttgcaggacacttttgtgcctgtatccaggatcatctctgacattcattgaaacactcttcctggctgggcgtggtggctcgtgcctgtaatcccagcactttgggagaccgactgagctgggcagatcacttgaggtcagaagtttgagaccagcctggccaacatggtgaaaccccatctctactaaaaatacaaaaaattagccaggtgtgttagcatgtacctatagtcccagctactcgggaggctgaggcacaagaatcacttgaacccaggaggtggaggttgcagtgagccaagatcatgccactgcactccagcctgggtgacagggcgagactctgcctcaaaaaaaaaaaaaaaagaaagaaagaaagaaaaagaaaaagaaacgcttttcccatggattcgagttttgcaggttgaggagtgcaacgctggtgaggattgggtgaggggagagcatgccctggaatttctgagccccgcccagtttgtaccttccacctctgccttgctgcacctccaagagttctcttctgtgtgttcgaatattttcagtaagatctctgtctgattctgattaagttccagatgttggattgcaagccacacactcaacttttctattaaataaatccttgtgacctgtttccagattattttggccagtcctgcagaaaatgttgccatttatgtattgatccatactaggtaatttggatggcaatgtctttatctttctggtagaaatgcaatatttgctgccttgaggataggaattcatatccagtttgtgcagagccagactatatagtgaaagcgtaaagccatctccctggtatgattttaaggtcaccatctcccagcttcccagccacacaattccccagagcctgaaattctacctttggagattctctgtttcaggtttcctttccatttcacttgcagagacacctgtggaaggtaagtctttttagtcatcaactgtctagtgagatccttttctggaaacaggtcaatttggggttaggtaaaggaagattaagaagccacttactcctcaaggtgttgtgtaaggaaaaaggatgcaataaggggagtgaaaagagccccatccggggaggctgcagtggagatcctgaactttggccttgttttacagctgaggcaatgaggatgccagtgtggttgttgcatttggggaatgagttgggtagctgtgaagcagtccttttctctcctttcagcatttcagtgcattgaggtcatgcaggcctgcgttgctgaggaccagctagtggtgaagtggcaaagctctgctctagacgtgaacacttggatgattgaatggtttccggatgtggactcagagcccaccaccctttcctgggaatctgtgtctcaggccacgaactggacgatccagcaaggtagccagggcggaactcacaggttccctcagtgcagggtttggtttcattttcatccatttttagatctttaactttggcttcaaagctgttagtgtggttaatagcatttgtcaagcttgtgcaagcttaatgaagtgacacgcttcttggtatttccaaggcaaggctggcacagaaagctgtgggtgtcaagcagaccaggtatctgatcgatctccaggtggaaaacaccatcttaacacccaccatcagagagtccttcccggatagctgggtcatcccatggataactccagaatgtggatcccagctggcctacctaggatattttcttcagttctgattgcctgtttaagagttaggcccccttcccaggtgattgttataggaatagccttcttttcaggaaagtccctgccctacgtaagatatgcgagtgaggctttactctttatttttaattttgtttaaatttttattttctagagacagggtcttgcttgattgccaaggatggagtgcagtggcacgatcatagctcactgtaacctcaaactcctgggctcaagtgatcctcctgcctcagcctccctaatgaggctttacccttttaatcctgtcaccacaatcatttcttaatgcttcaaacatccatattaagaataatacacaggcagggatgcaggcaagtagaggagatagaagtcacagtgtttgagatccacagggtgatgatatgttgttctagaacttaattaggcagcgtgttcagcgatcctatggatctctctgctgcaatagtatttggtcagaacagacctggggattccctgcctccaaaaaataaaaagctaaaaagctaaatttaaaaataagaattagttagaaaatctgagaaaagcaatagatattagagaccattcaacctaacctgtttattttccagaggtggaaactgtagagaaatggaatatcttctataagtgtttggccataactcttagtctagtattccccccactctgccgtgctctgcacttacacttttttttctttctttttcacagataaattaaaacctttctggtgctataacatctctgtgtatccaatgttgcatgacaaagttggcgagccatattccatccaggcttatgccaaagaaggcggtatgaatggacaagaccctgtggggaaaaggaaacagtgtgacctgtcccacatgccgataaggctgcaagtgcctgtagctcattcccagccatcttagggctcatttgtgcttcatcttgtagtgagctctgtatgttatgaatttgctgaattctgaagctggggtagacattagagatcattgagtccaatcccctcatttcacaaatggaaaattaaaactcagagaggtgaaataacttgcccaaagtcacaaataaacagtgcaaatagagctgctaccagcaataacactgaattaagaccacatcagggagcctagagttcatcctaagctagggatgttaaaaaattatttttaattatgtagcaataagcaaaggctttactggtgaattgctcaagctttacttttatctttttggaagttcatgtcttccagattcaacactggaaaacatcttctgccactcaaaggtagcctatggagccatattcttcaactatttgataataactacactttacagatatgaatgaaaaagctgggtaccaaattggagacatctatgagaaaggactttttcaagtggtcttgttgccacttctcttcttgcttaagagagatggttctagaaaacaattttcccaaacaagctgattcatcaattccctactcaaccctcacccgtcgcctccagcactatggtttggtctgagtactggccagggcctttgtgggggaacgatctcctggagtgcggttcagtgattatcatttatccctctgtcctttccagttccatcagaaggtcctgagaccaaggtggagaacattggcgtgaagacggtcacgatcacatggaaagagattcccaagagtgagagaaagggtatcatctgcaactacaccatcttttaccaagctgaaggtggaaaaggattctgtaagcacgcccatagcgaagtggaaaaaaaccccaagccccagatagatgctatggatagacctgttgtaggcatggctcccccatctcattgtgacttgcaacctggcatgaatcacttagcttctttaaatctctctgaaaatggggccaagagcacccaccttttggggttttgggggttaaatgagagtgaagtgacagtacctgagaggagagtcctgaggaaatggaaggagttgttataatttgtcctggttaggccctgaattgacctcccgggagctccccgaccatcattcccaggaatggcgtgcctggcttaaagagtgaggaggaacagaccctgtcaccatgacttctactgcccctgccaaatcatgcttttgtttttcagtccaccttatctcctgacatcttaaatactgggcaaggcttggattcttgcttaggctaaataattttttcttatggtaaaatacacgtaaaatatttttccagtttaaacatttgaaagtgtacaatttagtggcattagaagcattcacaatattgtgcaaccatcaccactatttccagaactcttctatttctgcccaaatagaagccctatacccattcattagtcactccccattcctctcctcccacagcccctggcaactaccaaactgctttgtgtctctatggattgcctattttggatatttcatatacatagaatcataaaatatgtggtctttgtgtctggcttctttcatgtagcatgttttcaaagttcacccatgttatagcatgattttgtacttattcatttttatggctgaataatattccattgtgtggatattccatattttgtttatccattcatcagttgatgaacatttagggtgtttcaacctttaggctattgtgaatagggctgctatgaacagatgtctgctacgaacatatgctgctgtgtacaaatatgtgtttgagtttgtgtttttcgttctttggggcatatacctagaagttgaattgctggatcatactgtaactctagtttaacttattgaggagccaccaaacagttttccacagtgactactccacactatacattttttactagcaatgtatgagagttttcatttccctgcatccttgtcaatacgtgttatttttcattaaaaaaaattattatggctgtcctggtaggtatgtagtggttatctcattgacttgcatttccctactgactaataatgttgggcatcttttcatgtagtttttgcccatttgtatatcttttttttttttttgagacggagttttgctgttgttgcccagactggagtgcaatggcacgatcttggctcgctgcaacctccacctcccaggttcaagcgattctcctgcctcagcctcccaagtagctgggattgcaggtgtgcaccaccacgtccagctaattttgtatttttagtagagatggagtttctccatgttggtcaggctggtctcgaactcccgacctcgggtgatctgcctgccccagcttcccaaagtgctgggatgacaggcatgagccactgcgcccggccagcccgtttgtatatcttctttggagaagtgtatttttcatcttttttcttatgtttaaattgggttatcttttcgttattgaatttataagagttctttatatattctggatataagttatttatcagatatatgatttgtaaatattttctcccattctttggattatcttttcattcttgatattatcttttgatgcacaaaaactttgaattttagtgaagtccagcttgatctatttttttcttttgatgtttgtgtttttagtgtcatatcaaagaaaccattgtgaaattcaaggttgtgaagatttatcctatgctgtcttctaagaatttttatagttctagttcttatattgaggtccttaatccatcttgatatttaagcaggacatgaataggggtcagaatatgagacagctgagcttggaagcacaggttccaatgctcttattttggtgctactgggacacaattttcagtctggtttggctgtggtgtttgacctttgtatttttcctttagccaagacagtcaattccagcatcttgcagtacggcctggagtccctgaaacgaaagacctcttacattgttcaggtcatggccagcaccagtgctgggggaaccaacgggaccagcataaatttcaagacattgtcattcagtgagtatttccttcaagccttaggtacctctccctcacgtttaccttacatcagagagaaatgacatctgccaaaagctggaggaagccaaatgaaagggcagtgcctagtgccctgccatcctgctctctgttcaccaaccttcctggaaagcatataggtgaggagatgggagggaagagcaggcaagttgagagccgaatttggaaatgctggtcattttggtcgttcctcatgggcagccacaaatcatctggaggaggaggtgtcaaattaatgccaacttcagtcttagcaccaaaccagctcccatctcaaggctgtctccccgttcatagtcaccagtttctgcatgttataggttacggtatgtattagtctgttttcacgctgctgataaagacatacccgggactgggtaatttataaagaaaaagaggtttaatggactcacagttccacgtggctggggaagcctcacagtcatggtggaaggtgaaatgcacatcttacatggtggcagtcaagagagaatgaggaccaagtgaaagtgatttccccctataaaaccatcagatctcatgagatttattcactactatgagaacagtatgggggaaattgcccccatgattcaattatctccccctgggtccctcccacaacatgtaggaattatgggagctacaattcaagatgtgatttgggtggggacacagccaaaccatatcactgtacaacagggccttcaagggaaaaccttggttaactcaggactactgacccataggaaggggcttaacctcatcatttgtggaggttttttttgagcaaaaagacatatgatatatttaacttacccacttttacattaaaaaatagcaagaaaaatttactagagacaacaaataatgtaaaataaaatgtagcttcatatgatggctggttaagggagatatttagaggcaggcagatggaatgaggagggggatgaagcagaaagaaggaaggagaatgggagaaacagatatatattaattttgctaagtccttgagtgacagagatttgatttttaagtacgtactaaaactgtcttaaagaatgaacaacgctttttagattaaaaatgaaggaacactgccaagtttttgcaataactgaggcaagctaaaaattgcttgaaatattcttgaaagcctcttatgcatcacatttttcaagaataaaatgctttatcactctggaaaatgtgagtatgacatgttttttttacagagaaaacatattctgttttgatggactaacattgccctctaggaactctttttgatatgctgtttaaatttttttaaagctgtattgaatttttgcaacactgggcacaaatttcatcagctcaaggagttttctccaagggttaaatgaaggcaagatccagccctggaacctagaagtttcctaccctggtctatagattataaatcaccctgcttccatttttgatcctctataatccattttccacacagcagccagagtttcaaaccctgaattctctgcttaaaagccacagtgacttttattatattttaaagaaaatccaaactccttcctataactttcaaggtctttcatcatctgtcccttactgaccacatttttcctactgctttctgcctctatttatcttccttaccttgttgctgcttcaaagcttttgcatccactgtttcttctgcctggaatgcttttctccatggttttgcatggctggatccttctcactattaagatcagcttgaatttcactccttccttggacaccttagctaaagttgctgtctggacgcagtggctcatgcctgtaactccagcactttgggaggccaaggcaggaggatcactcaaggccaggagttcaagaccagcctggccaacatggtgaaacccagtctctgcctaaaatacaaaaattagccgggcttggtggcacgtgcctgtaatcccagctaccagggtggctggggcaggagaatcacttgaacccaggaggcggaggttgcagtgagccaagatgcaccactgcactccagcctgggcaacagagcgagactccatctcaaaaagaaaaaaagtctaaaaattagctgggcatgatggcttgcacctgtaagtcctaggtacttgggaggctgaggcaggaggttgcttgagcccaggagttcgaggctacagtgagctatgatcatgccagtgcactccagcctgggcgacagagcaagacccatctcaaaaaaaatttataaaaattaaaaagtaagtgctcaataagtattcactgaatgaatgctgttggaatgaatgctgccaggaagacacctagatggggaggcacaaaattctgttttttgtttttgtttttgtttttgtttttgagatgaagtttagccctgtcgcctaggctggagtgcaacagcatgatcagcgctcactgcaacctccgcctcccaggttcaagcgattcttctgcctcagcctcctgagtagctgggattataggtgcacactatcacacccggctaattttttgtatctttagtagagacggggtttcactatgttggccaggcaggtctcaaactcctgacctggggtttttttagtggaaagaaattgaatttaactgaaagaaaactaataagacattgtgttgctgaagctactagaagaaaaagttaatcattgatttttgtcaagaaggtgaggaactcactactgacttttgttctttgtttttcaaaggtgtctttgagattatcctcataacttctctgattggtggaggccttcttattctcattatcctgacagtggcatatggtctcaaaaaacccaagtgagtctgcagacaacagtgggtgccttaaaaatcagggacaaaaaggggttgaagtcatcataggtgcttcgtaggagagggcactctaccattaaggggtgttcattcatttattaacttggtgcgtatttattgaggttattaaaggccacgctcagtggctcaccggaattctgaccaagcaagagcactttcgtttcccagagctccatgcccaggtctaggcctttttgaggccaggagagtgccagctgccccacaggctctgtctgctccatttgccatctgagactggagttggagagcagaccctttctctcagtgtctagcagggcccctggctgcagcaagaggccttcttgcgagctctgtctcaggcagagcggggagcagtgtctccacggtgttggagtgctggccagtcgtctgtgggtgcaagcttattgcttgcttgtggtgcagtgttgagggtctggctgcaggggcctttaacctgcttgccctggccactgtggggaagaaagcatgtcttcagggtcttagactttctctctgcagtgagccttatggcaccctaatggtcctcccctggttgagctgtctctccaaattagacagttgtgagtcatctctgtcaagcagctgcacttagttaatggtcaagctaatatcaacctccgttaccaactgtaggtaataaccaagccaccagcatagattcttgtacattatgcacttaagtaatcattttgatcttagcatgcatcagaatcaggcctcacccccaaagtttctgattcagtggttctagggtaaagccccaaaatgttcatttctaacaagttcccaggtgatcccaatgctgctggttgggaccacacttggagaaccattgcaggaaagtatgggtagcttataaggtttataaaatgttgtctttcccagaggataagcctcaaaggaatgactctgtgatggtgcaatttacagcattgggaccaggtatggagatgctgggatgggagagaggggaagataggctttgtatggggagagtctcctttgatcacatcccacagagaacttgcaatgtcaccccccaacacacaccgcaaaacaactccactttcccaggttctattaggcagacatgcccttatttaggagggaaacttacaattccctttagcacagcctcactcttttgactcagccatatggtgctaatgcttcttggattcaattcccatcttaaaatcttctctctcattagcaaattgactcatctgtgttggcccaccgttcccaaccctgctgaaagtagtatagccacatggcatggagatgatttcaaggtaaactctcctgtttttattaaggaaatcattgccgtgggaggtagacgaggtgaatggagatggggaaagagtcctaggctgagcttttttcaaggttcacatcaagagaactggagttgaaaagtctcagggaatggcaggcagggcagatggactcagccttcctggaatgactttgacttcatgctttgacaaggggaaagggcttcaccaggctcatgaggacccagtgcgttcccaggtggaactggtcccataaaggatgctgcagaataaagacactggccctacccttcctgacctgatgggctaattagagagagaggagccttggctataggatttgaagccatttacaaagcagccaagagcacattaatctaaagactgtctaaatatcaccagggaatgttgatgggcatggcagtctgaggctgcctcaggttgtttttctcaggctggggacgtcagagtcaggctttatttaactggcattggggttttctagtgagtattccttaactagaaaccctccatttgcataaatttttaagtggaaaaccgttagggaaattttaaggtttaatttcttgcttacgtagaaacaagcccaatcaaatataacctttaaatccttgttactgaaaggctgtttccagtttttccttgatgcacaaattttaaatattagtcctcgttcccactcagaagtcttttttgagcatgggccttttgttataatgggctttctttctgtttcctcctcttatcagtccggtatactggactgatttatacccccatttactttcctgcttattaaatgtcatttagagagtaaatggattcataggcagtgctctctgataactaacatgctttttgaataatccgtaggttggacctctagagccggcacttattaatcactcactacatgccaggtgctgggctaggccctagggatacaaatgacaaagtcactgtccctgccatgaggccacttctgattttctggtgaggttgaacaagtctgtctctatgatgtggtttttccatccctaagagttctaattttagttcttccatcttaactggggttttgtgaacatgggattgtgtggaaaatagccttgcacactctagcagaagaaattgtttgaattggctgggtacagcggctcatgcctataatcccagcattttgggaggccaaggcaggggggattgcttgagctcaggagtttaagaccagcctgggtaacatgacaaaaccccatctctacaaaaaattaaaaagtagccaggtatggtggtgtgcatctgtagcccctgctactcaggaagctgagggggaagaattacctgaggctgagaagttgaggctgcagtgagtggtgatcatgctactgtactccagcctgggcaacgggagtgagaccctgtctcaaaaaaaaaaaaattatatacatataaataaataaattttaaaaattgtttgaatccagggcactgtttctcaggaaatgtgccactccttccaagctctgtggaagggcatgcagagagggttggctaccacttctgggcctgggaggaaggtgggggctgttccagagatgggcatttgctgtcccaagcctaacgagtttttggctatgtcatatgtgactcctaaatgaccacttgggatgtccctttttcttttccaggataagctaaacctgaaggagtctgatgactctgtgaacacagaagacaggatcttaaaaccatgttccacccccagtgacaagttggtgattgacaagttggtggtgaactttgggaatgttctgcaagaaattttcacagatgaagccagaacgggtcaggaaaacaatttaggaggggaaaagaatgggtatgtgacctgccccttcaggcctgattgtcccctggggaaaagttttgaggagctcccagtttcacctgagattccgcccagaaaatcccaatacctacgttcgaggatgccagaggggacccgcccagaagccaaagagcagcttctcttttctggtcaaagtttagtaccagatcatctgtgtgaggaaggagccccaaatccatatttgaaaaattcagtgacagccagggaatttcttgtgtctgaaaaacttccagagcacaccaagggagaagtctaaatgcgaccatagcatgagaccctcggggcctcagtgtggatggcccttgccagagaagatgtcaagactcggcacgcagcgcttgcttggccctgccacatcctgcctaggttaaagtttcccctgccccttgagctgccagttgaacttggtcggcaaagatgcgaccttgtactgggaagaagggatggtgataagcccgagttttgtaaaggaacagcagtctcttttcgtttgttcagataccaagctctcaccgaggcctcctgacagattgactttgaaggaagggcccaggttctgagcccaaaggacccccagggtggacatatctggcctcccaggaattgggtcatggtcccagcctttgctggggctgagcctcagagttccagaaggcctttccctgctgccagaggacagttgttttgttggctcttgggtggtctggtgggagcctgggctctggtcttcccctacaaggtagccctgaagccttcctctctccccatagttggggctggaggtggagtggaccttcctaaggggttgtctgaggctcctcacatcctcttagatctcaagtgcctgtagcaacaccgcacctgagaatcctcacccccaatttagactgcattgactactaaaaaatcaaggaatggggagggccctggggaatgtatgctgccgggcgcagctctgtccagtctccagggggccacttcccagctgctgctgcccttctattcagcacccagcctgggagcagaaaggcacctgacattgcagtggttgtcatatagggacgctggcccctcacactggttcagagcccaggaatgcttacttaaaaggcctcttcccggaagcagcagggcagggcctgggaacatgcaatgcctagcaaatttgcagccccaacaggaggacttctgctccttttctctagctgagcacagagcttgtgacagttagtggagcctttcacgaaagtgtggattgctggcttcagcactgagatagtactgggctcctcctgtaactatagtgacagagtcagctgtgactcccttgacctttgtgggaggccactaggaggctggtgagatcagggcaggcgaggcaatgagtgagtggcccaaggtgcagtgaacccagcacttgccagccaggaaggctgatggtattttttctaggagagtttgaggaatcagtactaggattgcaggcatgaacttcgcaagccacccactcaggtgtgcaaaacatcactttactttcctaaaactaaaattaattgccagcctgagacctgacacttcaaagtaacctcagcccagtatgatgatttctgagttgccgtaggtttgtgactcagtcacatttggggttttgccctcccctgtcctgcctgggactggctctgagtgccgaggatgttcaatggcgcagcgtgcatggggcagagttggtcactcagtggcatcctctgggtcatgtatttgtccggccgtgtttttgtctctggcctcgtgtgtttactatggtccctcctgtccctgttgggtcacctaccacttaccttagccaattgctgcctcgttactgtgggcacaggaaggtgtggctgctctctcaaagctctgtcctcctaacatctccagcggctgcagccacccccccaccacccacccaggactcagtactcctggtttacggaacagtgacttctggtacaccaaggaatgagggaggcccgaggcagggcactggggaataagactctagggcaatgcccctgtcccgttgtcctgcactcaagtccaggtgtaggaagggaccaaacaaaagagatgcgtccaattctcatgccgcccctgatgtctgctctccctgctctccctgttctccaccccttctatggtgtgggctcttctgtgagcccactgtccccagagttccagatggggcctttggcaaccccaccttcagattcatgaacatatggggagattctagccttgcctcctgtcttggcccgaggatgggggagggcacgggtacccccacagctgttctttcaaccctcctgcccacctgtagttgggggaattttctcaaattctgtgggaggtgggtgagaggagagcctggaacaagttctcccaaacttgtctgtctcacacctggatgtagatgaagcttctgaacctaaaatctaagaatttgatgggagagaaaatggatccccaatggctcctgtgagtggattccagagataaggatgttgccctctggcccctgctccttcatcatcaaagctggaagcgtcttttgctggacaatttgcaaatccccacccagcccttcctgtttcatttcttctttcctttctctcctcttgcccctatcttgtgctttgttttcccccactgccagagcttctcatcttttaacacttgctattgttttcttgtttcttttcattcctttctccccttccatcagcctcctttgatcattttccatggttttattacctttgaggggtgggaagatggtggctctgtttctttctaggtgagaggagctgtttctatgagtccccaaaaggcactggtgggccacaccttagctctcctgagcaggttcacaggatgtgagcctcagagttcagggcgcaggtgacttcctctcctggatcgagtcaccaactgtccccgctctgggcaccagggactgcctctgtggctggagaaggccatctgtgttttccctgtttactgtcagagacattgtgaggacacaaacaggaagacttgtgttttagcaaggttattaaaaatggataaaccagttttctgagaccctgggatccatgcagacagctaggttagtggcctttctttaacagtaagagcagaaaatttttaaagaatgacagagaaaccagtctgtggcttaaataaaaagaccacaagttccttctggtgtcttgggaggcagcggtgtgaaaacaccacgcaagggtctggaggaggcaggagatggggagagatgaaaaaggagaggcccacagtatggatgcctccggctgctctgctgatgctctgtgtgcgaggaaagcctgtgctggcctgtccaccccagtctgattctgtccccatttccagcacgcccctagttactcctgctgcagcaggcaccctgccacccagggcagtggcccacgggccaaatccaggccctgtttttgtaggttcatgaactaaaagctataatgacctatttaatggttgaaaacaaaaagaataacattttgtgacaagaaaagtccaagaaattcacgtagtgttgacaaagtgtaattggaacacagccatgcccatcgttgacctattccctatggcggcttgcccctacaaaggcagagttgagtagtttcaacacagagtttttcccacaaagcagaaaacgtttactctctgaccctttgcagaaaaaatttgtggacgcctaccataacccacagacatgaaactcagactgccactatgtttcaactttgaattagctgcaaattaaaaagaaatcaggatatgtcattctgaatttctgaccaaataaggactgccctctttgaagggtgcacacacacttactggttccccaccagccctcctaaattcctgtccccttcccatagctaaggtcgagagttggtggcttacaccagtggtctttcaacaggagtgattttgacccccagcctccaaacctcagacatttggtgatgcctggagatatttttgattgtcacgactgggaaggtgctactggcatctagtgggtagaggccggcaatgctggaaattatcttataatgcgcagaacagccctcacaacaaagaattatctggcagaaaatgtcagcagtgctgaggctgagaagtcgtggcctgaactaccctctgccttctagatccacacacagtgttcacatgggtgagactcccctctaggtgtcccctcttttttctaatttaaaatttgttttaaattcaactttacagcagtaatcccaagagttttaaatagcaattatttgtcatgcttaattaactcctaacatgatctgtgtgcacctgtacacatttttcagctaattgcaaatcatactgaatacattatgttctcccatatataaaaattcatgcatgagcaaagcattttgaacatccatgaaaaaccccatggcgggcctgcatggtgtggtttgctaaggcatcccttggttgataggattcgtttaaaggtcctcctagtatagagtgcaatgcgataaacatttatcttttcttacctttgtcctgtctctttggggctgttttcaaaagtggaattgctggtcagaattttatggttgtcacattttgcgtgactgtgtcccatcaaaggttatgctgatttacagtatcaccagacatgtctgacggatcctttgtccttttccactgagaatcagctgtctaccactgtgagcttgattttgtcaatttatcgggaatagttaatgaaactttatagttatttgtgttgctttaatccttgtgaagccaaacttttctttttttattgttgccatgtccctgtgttgacattacagaatgttctctgcctccgtgctcctggggacattgacagaccagctgagttgctagaaataagagggactcagtaggcccttagcacagcgggtggactttgccatttggttgactatttaaaatacttgtttttgtagggcatctgaaaaagaaatttcacactggtgtattttgttaattgtttctacgtaaatgttgattattgacaagcctacttgtaatcaaaatgtgtagtgtggtcagtgtcttgcactcttatgttgtggcggggggggggggcggttcctgaagagtggagtgtgactaaggataacagcagtcctcatttcctttggacactggggtcagtggggagagagtttgctccgaagcacaaacagctccaatccatgctggaagagaccccaggccacaatagcccttgacacagagctctatgcagggctgtgctgcccaagacgcttgtcgtgtgctgatgaaaagggctggggagaagcaaggggcaggggaggggcagaactccacaagagggcaaaacctgctgtcagcaatgctctcgtggctgttcaagggaagtgagatacttgtactatgcatttcatttttaggactagaattctgtcttcctgcccaacttcaatataagtgtggactaaaatgcgagaaaggtgtcctgtggtctatgcaaattagaaaggacatgcagagttttccaactaggaagactgaatctgtggccccaagagaaccatctctgaagactgggtatgtggtcttttccacacatggaccacctacggatgcaatctgtaatgcatgtgcatgagaagtctgttattaagtagagtgtgaaaacatggttatggtaataggaacagcttttaaaatgcttttgtatttgggcctttcatacaaaaaagccataataccattttcatgtaatgctatacttctatactattttcatgtaatactatacttctatactattttcatgtaatactatacttctatactattttcatgtaatactatacttctatattaaagttttacccactcagccaggtgcagtgactcacacctttaatcccagcaccttgggaggctgaggtgggcagatcacttgaggtcaggagtttgagaccagcctgggcaacatgctgaaaccctgtctctacaaaaaatacaaaaattagccaggcgtggtggtgcgcacctgtaatctcagctacacgggagtctgaggcaggagaatcacttgaacccgcgaggcagagattgcagtgagccaagatcgtgcctctgctctccagcctgggcaacagagcaagaccctgtcttaaagttttacctactcagctatctaaactgaggctccacaatgtaaatacgtgagagatcagggaagcctggtggctgtgggaaagggctccagttgaccaggactcggcagctcattacactctttgctgcaggaaatgactcctgcctgcatttcctgtggaggatccgagacccacgcccgggctctcattgtcttcctattccaggctccttcccgctcctggagctgccgctgggtctcagctctctgctctgaggctacgccgcagctacagctccctgacctgttcctgttcaggctcccaggaaacctcagagtggcaggtgcctgctgtttcctctgtctcccgcccatcccaccacggcctctcctgtactttcaatttgtttttctttagccattccttcccttcagcttctaaacacagttgggtcacttccattaaagaaagaaagagcccctggatcttcctctccctctggctgcccacagactcttgtcacaacgcaggccgtggtttaaagggaacgtggtctacagcccgtctggcagcttctccaggcagctgaacttgtttccgtttttggtagtgagaaaattgcaccgctagaactttctagaggtgtagaaagcagggagtcactcaacccattctggttcgggggactgccagattttttttaaaaaaaagggggtgtagaaagcaagtgagaccaaacaattttgggacaaggaatacggacacagaacagactggtaagtacccaagtgtatgacaaacatccaccatggatctaggagaagccctggggcagggtgatattcacccgcagagacccctgttcatcactaagcttatgaagaaccattgactggcatttaacaccaggtgctgtgctcaaggtgtggcacgcagtacccagtaagcctcacaactgcattgtgagtaggtagctctggccagtggcagatgaggaggctgtgctcagagaggctagatgacttggcggaggctctctgaggctctaagcgggaagtggggggttggagcccagccctttgactttccttgtgcttttctacctcgggtgagtaagatgaccaagggactggggagatcaagaggagtggagactccaaggggacccctttttggtgagacgtgtagaccattcccctctcccctgggtgcctgcagagagctcttgagactggttttagagccagtgaggtctaagagaaatgctgacggcaggtgtggggatggagaggggaaccatgtccatgttcacagccctggtgacaagaagacagaagcccccagggacccagagcttcagaagggtttacgatggctacagaagcaggtagtcccatgacggtgtagaatctgtaagcacccccaggagctgggcagggcaaaagcaggtctgctggaagagtggatgtcccatgactgttggaataaggtaccacgtgggtgcctcctcccacccctccttccccctcccccacccccacgcgcccttggggcaaagcgagactcgtatcaaaataaaaataagttattggctcacgagttacactttcagagtccacagacttagcaaggattcgtgtcctcttgccgctgtaacacatttccataagctcaatgccttaaacaacaggaattgatgatttcacagttctgcaggttggaagtcacactgggctacagtccaggtgctggcagggctgtgttcctctctggaggccatagggaagagtcttccttgcctcctccagctcctaggcgatgcctttattccttggcttgcggctccttcctccgtctgcggagccagcggtgttgcgtctctcagttctgcagtcacactcgctctgtgtgcaggacctgggctgcacagcatgaaggccccaactaaagcctccgtctccatgtagggactttctcccgagatgccaggtttgtccttttaggagttcctggcccatagaagactgtggctatatagtcttatgtgagatcagaacccaatgggagcttgatgggaactgagcccagaaacccatcaaaatctcatcttattgttgtcaaagctatagggccaaaggatctagggcctagaaaacctagccctagatccatggcccagggggctcactaacagtgcccctagaattagacatcccaggtccctggcccagctggattcccacaggccttgctctgcagggacaagatcctgagagagcaggaggggcagactctgggggtagaaccaggggctgtcttggcctcggcccatcagaaccacaagcgcaggcccatggaagggcgaataaggggaagtccaataacaataaggtccaaatgaacttccatctgaattcagaattcttaaggattagcaagtgctggagtttgtgcagggctcaggggtccaggaaggtgcaccccagttagtgaaaagcctagggtgctggttcagtcaaaaccacgactgcatatgtgcacctcacacatctcccaggggcttgatttcaaaccttccttcataggaaacaagccacaggacacaaaacacatccagttggccttttgaaagaaataatatgtatttacttagaaacaaaattgcacttttccctataagtcaacaaatgctaaggattctggacgtcaaatacctcccaagacgttttatcagccagactttgttgtccttcaggaaaaaatatgagttccaggaaaaatgacaggcatgcaggatgctgatttccttcctgatggtaagacagcagcctcctagactgacgatttcgtgacttctcaggggctgggtccggagaacaccttactttaaacaaagggagaatgctctgtccaaaggcatcttctcttgaacccaaagcaatgttttcccatcatatatcagaattttcactcttttctagatccttatcccctcactaccccttccccatcaaaaatataaaacaagaaattttaaaaaaatcttttttttcttagaaacacagtctaactttgttgcccaggtcagagtgcagtggtgtgatcatggctcactgtagcctccatctcctgggctcaaggaatcctcccacttcagtctcccacatggctgggattgtgccactacacccggctgattgttttgtttttttgtagagatgggggtcttgctttgttactcagaccagactggtcttgaactcctggcctcaagcaatcctgctgcttcagcctcccaaagtgctgaaattacaggcatgagccactgtgcccggcacaaaatcttccaaaaaacaaaacaaaatgaaaaccccaggagtcctgaatatcatcctttgagtcctcctgacctccttgtctgagagagccttgagtgaaggagctcaggacggtacccctgaggcctgcactccagcctaggtgactgagcatgggtgacccgtcactgtgctgccgacagcagaatggactgacagggcttccagatggacaccgtccctgtaagagcatcttaatgcctcaggctaagtcccatgtcagagtcagggcttagctaacttaacaggtgggaagctaacttaactcacggcatgtttacaagtgtgataacatttataaattctaaaataataaagctaattgtattagtctgttctcacacttctaataaagacatacttgagactgggtaattaataaaggaaagaggtttaatggactcacaattccacatggctggggaagcttcacaatcatggtggaaggcaaaaggcacgtcttacttggcagcaggcaagagagaaggagaaccaagtgaaaggggaaaccccttataaaaccatcagatcggccaggtatggtggctcctgcctgtaatcccagcactttgggaggccgaggcaggcggatcacctgaggtcaggagttcgagaccaacctgaccaacatggagaaaccctgtctctactaaaaatacaaaattagcctggcgtggtggcacgtgcctgtaatcccacctactcaggaggctgaggcaggagaatcacttgaacctggaaggtggaggttgcggtgagctgagatcgcgccattgcactccagcctgggtaacaagagtgaaactccatcgcaaaaaacaaacaaacaaaaaacaaaaaaacaccatcagattgcgtgagacttattcattaccacgagaacagtttgggggaattgcccccatgattcaattatctcccactaagtccttcccacaacacgtgggaattatgagaatataattcaagatgaggtttgggtggggacacagccaaatcatatcactaatgaacccacttaattaaatattcttcaattttgtgattttcttttcttggttatttgccatcaattgttttcttcaggtcaagcatatttttgtaggtccccaaaaaaactcactggcctgggagcctgcctctctgttgccaggtggatagaatatctctggctaagtgttgtaatgaaaatgccctgctggcgtctaattggagaccattgccgggtggtcccaggtggagggcatagggttggggtcagcttgggctgtgggtggagaggcaggaggtcacctgcaggctgacaggacccagccatcgtttcccctcgtcccagactaggtgttaaacgtgaagcattaacaggtagtcctgatgggcctttctggagtttgctaaactgaggtctggtgagtgagtctgacgctttgggtggttctgtgtgcaactatcacctggaccctcctgtgaacactgtcaccgcagataaggaccacgcccaaagtgtcccaattctgaatgctgtatttgtacagggatggggttaggaatggaaccttaggttaagtccccccaaagcaaatcctgagacaaacatccaggtgtaactaattcatccagggcacattcccaagagaaactggtgagcgagtgagggaggcttgagaggaggggaagacgccagggcagggtgggatttcaggcagagccctgcaggtcagcgccagtctcatccccagatgatgctggaggtaagtgactcagtccttggcgcgtgtcctccccaggcaaggggcctgggctatcacactcctaagctcctcagtctactagtaaacagctgtccccacagggtatgaaacctccaggcacatttgactgtgtgcttggaggccaggagtcaggctccggtagcctgagggaagctgtggaaagataactgcaggtgcccgcagtggaaagcaaagcccagggaagctggtggagatgggggcagatcctgttgccagatttggcaatacaaaatgcagagcacgtatttacataacacacaccaggtactgtcctgtgtgtttttcaaagactatctcgtttaatcccagcctggccagctctggagtgggtgctcccctagttgtttttttttgtttgtttgttttttgggtttttttttttttttttttgagatggagttttgctcttgttgcccaggctggagtgcagtggcgcaatctcggctcaccacaacgtccgcctcccaggttcaagtgattctcctgcttcagcctcccgagtagctgggattacaggcatgcgccaccacacctggctcattttgtatttttagtagagacggggtttttccatgttggtcaggctggtctcgaactcctgacctcaggtgatccgcccgcctcagcctcccaaagtgctgggattacaggcgtgagccaccgtgcccagcccagtgcgcccctattttgaaggtagaatgtagtcgtttgaagcaggagcactggggtcagactgaattttaagccccagcgttgctccctgctcctctgttgccttccacgagttcctcaacctctctaagcttcagttgctttatctgtaaaatgggtgaaatagtatcaccacaacaattggggcagtgaaacgaagcagtgattctaccacttcattctaccactgtttgctgcacatagtgcttggcacatagtaagcgcggggtgagtaacagtggggcttgttgtcatcattacagatgaggtaactgaggtgaggaaagcccatgctgtttctaaagggtggctttgcattggttttcatttctgtgtggggccaggggaggggtggactctggggaggtgtgaacctggctgtgagtgcatagggcaagagtcccctattttccagccccctctcagggtctccttcctgatactgtccacaaacaagaaggggtccgcccagtctgaaggaccccagaacctcacggcaggcctggggaggctaggcggcgatgctgaaataaaggaggaggcaaggaggagaagccgggcaggggattgtctagaattgtccaaaaagaggaaacgagctatttctcagctctttgcctttagtgcttgcctggagatgccattgttagggtcccaggccagtcccacaatctagaaaccctccctccccacatttcatagacacagccatagtcgtggcatggacactgcatgagcccctgcaagcaatgcacaggcctcctcaggaggggaggtgccacctggtttctggagcctcaggcctccctcaccctccgcaggatgcttctccttggacatgatgttcccaggcttggaagcagctacccttccttcacctcacaggctcattgcccctctctttccctggagcctccagctaaccagtcgccacgtctggccgcgctgctcctgagctggctttgctttcctatttttctcctggcctcagcccccttcagacttcaccctgatgagaaaagtgctcctgagtagtgtcctgtctcaggcttaccctctcttgtccattcctcaagtaggtgttacaataatctcaaagacaagaaagaactagaatagtccccatctcatgggatgaatgacggaaagcccagctccccagctggtgacatcatcaccaagcagggcctggactggggcaagtctagggctcccaacagaaggaggtgctcactttcggggtcacgcaagggcaccaagtacctcccatgactgtgtgccctgggtacctctcttatctcacccactgtgtttcttactcttctctctgctacgggaggccctttgacatcaccagattgtgacctttcatttagcatggaatcagtagaaaatctgacacctgcagaattatctgcacgaagaaagcctccttgtttggaaatggggctggcttacattcacacatgactctattggagaagacagaaacctgtttgatgttgccttaaatgtagtaaaaatgttgtggttggactggcacagtggctcacaactgtaatctcagcactttgggaggccaaggcaggagcatcacttgaggccaggatgttgaggctagcctgggcaacatagtgacactccatccctacaaaactttttttaaaaaattagccaggtctggtggcacacgtctgtcatcccagttgctttgggggctgaggcaggaggattgctccagcccatgaattcgaggttgcagttacctaagagcgcataactgcactccagcctgggccacagcatgagattgtgtttcaaaaacacggtggtgattagacgtctcttttgaacctgcctcaaggtcagaggtgtatgattaggtgccaccttgggcattcctttctgtcctgggagtagaaaaagtgtaagattacctccccacgagcacttgagcatgggttgtagataaatccatctgtgtccctgctggggctgatggagatatgaggactgaggggtcctccttgcttgaagtcacatctttggcaaagggctggaaagagggcagggaatatctagatgttgctcagaggggtcaacaaaaattcttccggccagtcctgaaatacaagtctcattgtaacaataagaattatagtttagtctgacccagagaactgaggcaacattgatttgaaaacagtttgtgcacactgctggctctcctggtcaccagctcatgcctgcacgacaaaattctacagaagatgcttttcctccaggaaggcatcccgatgagcacagctttttgcccgaacataaaatgttttctgaaaaatctttccccaaaaaagagggagtgctttagtaaagtacttacaaagtttctcatatcacagtttctctcttcttatttatttatttattatttttctgagacagattctcgccctgtcacccaggctggagtgcagtggcatgaccttggctcactgcagcctccgcctcccgggttcaagtgattctcctgcctcaggcacccaagtagctgggattacaggtgccgcaccaccacgccaggctaattcttgtatttttagtagagacggggtttcaccatgttggccaggctggtctcaaattcctgacctcaagtgatctgcccactttggcctccgaaagtgctgggattacaggcgtgagcctctgtgcttggcctctcttcgttatttaaacacaaaagttctgtttgcgaaagacccattcactaaaatgacctcatccaatgttaatttttaattttgagaatcacacggagatcaccagaaggaactggcataaaaggagacaagggatttagtcattattcctgggatatgatctcaatattaactaggttagatttcagtgtaaagttttttaaagaccattttaaaaagcaaaatggtaacaggttacattactgggatggggggaaagtctcttaagataaaagtggatacttaaggcttgaatactgttttccacgacagcattgtctgctgtctctcacacaactagatggaaatgttaggaacgagctcccaaaacctgtgcctatgattcacaaaggggatctggtaatgacgaggaaggacctcagtgtccaattgcaagtgaagagttgcatggaactatcttcataaagtacgagtgaacaaaatcaattctatatttctgcattgttccacatcatcttatttaaaatatggatcataggcagacatctgactatttaatcaacatctgtaaagctcacacagttaagctgtccaaaaacttttcttgggatcttctcgttgaggaattgggggattgttttatactgggagctgcctggtgtttggccaggggttggtcgtagcctggtttgtagggcctgagcctacttgcactttctgatgtgttcttaaggcggagcctgatcctggttcactccgtcttcctcactagacagtaacttcccaaagggcagggccgtccttttataacccacaaacccagcgttttctcctgtgctgttggaaagtttgctggcccctcttctctggacctcattttcctcgtccaggatgaggagtttggataaaatgatttaataaggatccatctgactttaattttctctaaatttttgcttttggattgagtatatattttgcttcaaatgaaagctcttgccaaggcacggtggttcagagatgtaatcacagcactttggaaggccaaggatggaagatagcttgaagccaggcatttgagaccagcctggccaacaaagtgagcccgtgtctacaaaaaagaaaaaagaaaaattagccgggcatggcagtgctgcctgtagtctgagctacttgagaggctgaggtgggaggattgcttgagcctgggcaacagagcaagactctctctctcttggttgggggaagctcttgcctgtagccagggtgggatgggaatcaggaaatgatcccaggtttgagatgcgaaggaggcagattcctgactgcctatggcactgtgcaactctggattagaagaaacctgagacacattttaaacattttttaaaattaaaaataacttgtttattcacccacttacctgttcatataagcaagctctgccaaacaccgagcactatgctgggccaggagaggactgagctggggccctctctccagaggcccagcagtaggtgccaggatatagaaggcccttaactcagggggaaggagagagaagaatggaagatttccctcaagagggtatctatttgagttgatttttggtgaaccagtaagaatttcccagcttaacagggactggggactggagaacattctaggggaggaaatcatgtgcatgggctaggttagaagaaactcagtatgttctggaaactataaagtgtgcagctggggggttggaaaggtccagcgaggccccaaaaggacagaaagcaaatgtggggaatgaggtcagcacagcggggcagcagcaggcagcccctctgggagtggcaggagatggagaggagtggctggcggcaccgtgaaggtgaggcaggctggaacgggtgctcgcgctaggcagcgggcccggggaagtctgtggacagaaccacctggggtaggaccgtggtctgagcacccaggaaaagcccctgccggagatcctcctgtcactagttgccatgggctagattccaccattagaggagtctttctttggccaaaagaatgagactccaggggtcgtgtgagggtgcattctcaggaaagtgggacacattgacctcttttgcaggggttgctctatagggtcagagcaaatgtatgtgctagtaggggtggggagccagcctcggagtaaaccttgagggcataaggagaagtactgctctgggctcgaggctcagttaggacacttcaaggtaggcaattgcagggggctgcttgagggcacaaggtgccccatattcacaaataagggtggtggggagggagatgaggggaagagaaactcagaagagtttgaagggcctgggaagcaggtgtgcattctccttaagctagcctgggcatgacgtcatcaagaattttgcttaagtggttgggtacaattggtgtacacatcaaagaatgcggactttggatcaggttggagttggaactccactgtttgtcaaccacatgaccccgggcaagttattcaacctcttggaggctgcatttgtaaatggtgctggtatttacctcataagtttctaggatttcataacccacagtaaacacttcatagatggcatatatttgctcacctttggacaccctgctccggcatgtggcccccagcaggtgatcagaaaggtctgccggttcatttgaagaggagcggcccctcacccccagcagcaatgtctagtctcgattctgaccgtggcagttaaaagtttcttggaggtcctttcctaggcactgatgctggctgggtagccctggtgttcgtatgtctagattgaacaactggcaaaatccacactgactttgacctgaagagtggctgacttttcattctcagaacgcttatgcagaattatggtttctattgtcagaatctcagtgcctttttatttaaatattccccttcatgccattcctttaaaagcattatccctctcataaagcttatagagcctatttccaagaattttctataaattcatttaaaagctatcattagtcaacaggctgcttctgactacaggcaagactgcagggaaaaccttttcctacggggaagggacccagatgtatacttaatagttgtgtcttggacctgttactaagtgaagattgttctaggaaagtaggcctggactgaggtattagatttctaatcaacaggctggtctcattcagagtttgaaccagcactctgggggagaaaccacttgtggccgttgaattactctggctagcctgtctcagaaagaccatccacagccagggctaatgagacagttgaagaaagagaaatactttacctgagggttttggtttttttttggcttttatttttgtgtgtgtggattaccaccatatagctcaccatgttatcccagaaagactacaatttcatacagaatgcacagatgtttaaataaaaagccatttaagtgaggggataattctcactaaaaaaagctcaaaaataagaaatgacaattctagatacacttttttgacatgtaaaatgacataaccatagtcacagggaataaagaatcaggtttgaatgtccacaggtttctaaaactaagctctggcttcgtatctgttgaaaatctttagcggttggggaaaatagctatatttaaaaacaaatattgaattttgagttgaaaggtacattttcctcccttgatggagacagaacttttctatggagaacccaagcagcctttccatgatcttactaagttgtccaagagccaaccccgatcagcagcaacaggactcaagctgttcaccctgctttcgagttggctgagcttcctgctgctttcacacattcttctttttctacctcagttcctctttgcttgtagtctttcactccattaacttgcccaagcactggacttaagtatggaagagcctatacgcagttgtaatatatttcgtattttgaaagtgtagaagtttgtattaatttaaaaagaaaaagcttaaatggaaagttaagcaatcctgaacaagaaaactctctcactgcctttgggctagagaaagagtatgctctcaaggagttacataatcttttccaaagcaggatggactgtatctatcatacacattaggataagatgagccaccacaccttaaagaaatcaggcttgagcctatacaagccataaccaaatagaagattttaaacaaaggagcacatagcccaaagctgacatgttatttctataaactctggtatatatgtgaaggagttactgttggctggcttgtgggttttttgactcactacatttttttagacaaaatcacaatgtgaaggcacattaatagttgagattttcttttccttccaggtggacttgctgactgattagtttcatatactacttagtaacctcaagaagtagcaggaggatgccatgtatcaatcttgaacttcaagtctcactgcaacaaggatggagactccagcagagtgcagggtgggcacagacaggccacaagatggcgcagcacctccatacttgggctcttgacaaccaagtaggtttttttttttttttttttttttaatgtccactaggagggaggatgctacgatttcagacctcagctattaaatagtaaatctggaaaactagtggataaatttgccatctccattctatgttattaagaccaagatagtgtactggttttcttttaaatcacattccattatgtcatttaaaatgtcacaaaacccacacgaagcatctcatttacactaagatgcttatttagctaacaccactaatgataaatgctgttacaaatatgcatagtcagatgatagtaaccacatacagaaaaaaaatttgaacaagtatttatttcttaaaatttacttaagggattagagctaatatataatagaacatttaatataacatttggagttatgtcaacataaaaatagctgtggttacaattagcacatgcaattcactgcaaaggtaaaaatacatgctatactctagacaagccttccaaatgaagttagagtagatggggtaaaacagcaagtgaacatgaaaggattgcacttagaagaaagtgggacatagctaggatataaaagaaacatacctaatgctagtcagtcactgcattgtcctactagcaaattgcacatttatttttagagtatattcaatacacatacatattgagactagagaattttcaaatatctacctttgaaatatccctttgtttctaacacatcacattatggtattaatgtaacagcacttaaaacctgtagttatcattcaaagcttgtgttcaagagataaaagaacatcattcagacaaagcctgtgttcaagaaataaaaaaaacatctatcactatcggccttaaatgcatctcatcacacgacccatcaactttaatgaaatgggtaatgaagttaaactaaccagtttgtacaaactattgactgagaaaaagcccttaaaaatttaggaacaaatgagcaacagaagagctcaccctgagctgccaccttttaatttttaatgcaatgtatatgagaatatcatgctaatgcacatactagtagcatgtatgatggaaaaaaataggttaatgcaaaagataatacgcttggctttgtaaagttttgttttgacttacatcatctgaattctgtttatcgagtctgaaaaggaactgctgccaaggaccagtccaaagaagaattaggctgtaagactgctagttcataccttctttgaaatcaatgacaatgtccaattttaggctaatcctaaaacacttgccattttatgactccatattcttttaatttacagaaaagtacaaattttttagaaagtaatcttatcagcacaatataatctaacaatacctgtaatagaaagctatcccagtaaattttttttgaacaattgaacttttgtcttatgcagcttataactttgttattttattcatctcaacaaaataaaactttattgaaacaaaagtgtatggtttaggaatatgctcttaataacaactgagcaaaattagaatgatgtggactataacagaatgaaggaagatctctcctgcttgatgtacttggtcaatatatgttagtaaacagaaatattttagggaattctatgattattctacttctacatttacatgtcatggttttaactagttaaatgggtagaaaaaagacatctttaataattgatttctatttctcaaactagatgctctactttaaatatgagctttaatgaatgttttgtaacattttaaagttgtaacatttctaagtatactccactaacttcacaataagagctagggtcactggatgacttcatgtggtaaaatcccttatcaaggaataaggctgaaatttaaatgaacaattaggtagagaagaggtatgaacacagaacatgtgaatgaaatttgctttttttccttgctgctgttcccgagtgccgactgatccatagtaaaaaaggacaagattaaaattttaggttttaatggtacaaagtgtgaagttttatagttttctaataattattcagtattatccctttcagagatgagggtaggataccacagacatcagtaactgacaagttataatatcaacacatgtaacatttgggtcattattttataaccctaaagggagcaactgcaggtgcagaagcagtgagtgaactagttttgtccagacaaggttttctgatgtgctattactttaaacaccacttttggacactaaagatttaaagtgataaagccactaactaactttattagactagtttttacataaataaccagatttctttgcctacctaaagtacaatttacatgcatcaacacatagattattctaagacatgcttgggaaagtaattttgaatgtaaaaagttttataatttattttctccttagggcaggtgtacattacatattagtgctcaaatatatgttcatttccagaatgaatttttgcacagtaatcatatatccatttaatatgtataaagtgttcttggggatgggggtatattcactcactgtaccatgttttatacaggcttcaacatgcaaatttgtttatatcatggccttcaatgatcctccattctcattcctgtagattaagagttcatattgtatatctgaccctgaaatgtacaaacttcacactacaacattcttcatgacactatttgttatgaggaaagttgcagctaaatattagtcatgtgacttaaattttgagaaaatggaaaatgtaataggtataaatttcctgacacatacagcaagacaaatccagcccagcctttgatgatcaacttaaaagctggagatgtcattatcttgttgtgtaaatttgggtctatccctacctttacttctctgtgcctgattttcctcatctactttgaattcgtcattctattaatctacttttgcctaaagtgggaaactgaatatatcagaatgaaacatctatttttttcataaagaagatcatataatatgtgaaagaactttgaaaggatgaggcattatataaatgcaagaatataaaagataaacaggaagtctaatgtgaacaatattctgagagtaaaaagtgtaattatatttccattgtaaatgtataccaagttttcttagctttctattctccaataacctctagaaactattctaagcatgcctggtttctgtaacttaaatatggcataaaaacctgtttcctttgaattcacttgatagcagtagtcaatcactaataacgcttgctaatttcctcttactttctaagaaaacccctatatttagcatctgcttccatatcgcacgtggtggttaggggacagcataagtacactagcggctttagcactaaactcgaggcctgggtcacttctcccttgaagaaaaaaggttttaaaaattcctaaatcacaatgtagaactaagttccaccctacctcagaactgcagacattaaaataccatctctttattaagtgtctctacaataatgatatttgctaagaacaagatgtacattttttggggttctgttttgttttggcaaatattgcccaagttgtcttagtgtgcctcaaacatttactaaaaataaaaaaatttaaatctttgcctacttatttaaaaataaaaaaaatactcaaaacaaatttaagctgaagatatatactgtataaagtgttcatctacccagtactctgaagtcttaagaaaagtcaatgatatgtgtgtgtatatatatatatatatatacacacattagcaatttaagccttttaacatgccaattttttagatgctttattggttttttttcccctttactactacttcctgttttcccctttactactacaatttaagcctttaaaaatggcaattttttagatgcttgagatagtttgggggatccctagctcttatcatggcactctgttgagtttgtgaaatgcatcttcaaagaggttgtcaataatatgcaaatttttgaaaactagtgagattactaattattgatgaataaaaaatgagtacttttaatctgccaagttaaagctctagaattccttttctccagtaataactcgcagcatcactaccaatggaagggacctaaggaataccgtgtacactgatatacacgaagctgctcctcatttttttgtcagattacaaaagctgggctcatgtagttatggcctatggacctctttttaagttattttagcagaagtagatgatggtctacaccttgctcctcttttatattaactgtccctaagccactctgatgactattctaatcaaaatcagtatagctgtgctcactaagcatatcactgcttattattcaaataccttctgttttctatgtagcaaaacaaaaagttttataaatttcagataagctttctgtttttcttcagtgcaaacatcctgaaacagcacaaaatcattcagctagtctgaggataaagtcagtttatgtagtgcttaaagtagaatcccagatattctggaatggaaatagctcatgtgaaacttcagttcatttttgtccttaagggcaaatgatcatcttcagagagtgaagactttttaaaatctgaattcacagataaaatcattttagctttactttataggtactgctgaagttgtagcaggaactactagtccttcactgaggcatgtagccgccttgccgtacagtctgtggtaagtaacttttaggcatgccttcatcagtcgcagcctccatgccaactgtttcaaatctttctacttgtccctcagtacctggaccaaaagcatctgctgcagaaacttcctgaaacattttcatttgcccagatccacaggattgtgaaatatgatctgaaatctgctgtttaagtctaacaaaatcttcctcattgactgatgaaacttgctttgacctttcaaaatgtgaaatatctggactggattcatgctgactgcagttctgtttgaagtactgttgcctgggcaaaataccatcaccgccatctacatgatctactaattgtagatcttctggccgctcctctgaatctaacaagggctgggtagactcggatcttgagaagacttggactgacggaacttggtgtctgtagccactgtgtaccacggtagaatactggacagtgctcgaagtgttttgtgaagattcattttcatcactgctagaaatgcttggcctagaagatgacatgcatgaagaccccccaataccactgctgtgtccttcagtattaattttttcctttttgaacaggtccaatgatttcagatcttctggaaaaggctttttgtcatttgcttctatttccacaacacttacatcagtgaaattgccatctgaatacatttgatcttttgaattaaaattgtgctaaggaagagaaaaaattgtatatggcaagtattagttaaagccacagagctaatgcatctctgaaacttcccagtaactctcagtggtacagaaataacctgtattatgtcactaagtcactgtcaactacccaaaatgcagatactataaaatgagtctaagtagtctaaatcaatattgttggtgttacattttgataagctaatggtctacaagtagtatttaatatttcatgcctagactaggcagcctaggattaactggacagaaaactagaaaacattaaggaaaatcaaacctgaatgacagagattttgtagaatataaaaatacataatacattttaatctgttaatataaaatttaaggactaccggaggataataaatataaatgagttcccctttggggcatatttaaaattcagagtttagagtaggttcccagagatcatttcatcagtgctaaaatgataaactgttgaacttggttttaatactcaacccaaaatgcttgaggtagttaccatcacatagcagtttcagcacctcaagttttcagtttgcaagttcaaccaaacatctgtaatgtgtactaaacaatttaaaatatcagaacaaatatactatgatggtgataaaacccctaaaatatgtcatacatattaaattttgattaaaattttcagttatgtactgttttatcttcatttactttttgattcagcttgaatatcttatcttttggtacatttgtagatactcaatatacctactaactgtagatactcaatatacctactaacatgtctgtatattataaacaactcagaagcattttctcttacccttggaggagtgtgaggtgaccactgggcaatatgactctttgaaggatctggaacattaggccagatgtgttttttaattctgaagagaaaagaaaaatggcctatgtaaaaccacacataataaacaataaatagtccctatttctaaacatgttcatcaaagactcttacaaaccaaaccaattacctaaatgaacaaaaaatacctactctaccccaaacaaaaattatttttcttataaccaatagaaaaatactgttgaaaatgcataaggattataatgtattcataatgaattaacaaagctaaatctaatcagtgttcaaatttttttttaaactctcaaaattctgcaattaaaaccacttaaaatctttacccaggccacatgttgtggtattccaattaaaagaatccagataacaaattaatgttcccactgataccaaaaaagttcaaatataaaaatcaaatttaaaaaagtgactgagaatggtgcttcaaagagtgagagcctaccagactgactctcctgtaggaaatacctataacatttggaagtaatataaaaagtagtaaagctgacaacctagacaaaccaatgaatgaatccttgaaagacacaaattaccaaaacagattgaagaaaaagaaagctatatttataaagaaattgaatttttaattaaaaaccttcccacaaaactctgggcaaaaggaaacaattgtattaatactatacaaactctttcagaaaacagaggaggtaacatgttcccattcattttatgaggccagtattatcctgattttaaaaccagacagataaggcacataaagacagactaacttcactcatgaacacagatgcaaacagtattaaactgaatgcagcaaaatccaaggaatgcaaagatgttatatgaaaaatcaataaaatgcaccatattcatggaaggaaggagaaaaaccatatgatcatctcaatagattcagaaaaagcatttgaccaaattgtgacacccattcatgataaaaattgctagcaaggcaaaacagaaataagaacttcccccctgcaagtagtagtaaaggggaaaaaaaaacacaaagcggctgggcgcggtggctcacacctgtaatcccaacactttgggaggctgaggtgggtggattacctgaggtcaggagttcaagaccagcctggccaacatggtgaaacccccatctctactaaactaaaaatacaaaaaaattagccaggcatggtggtgcatgcctgtaatcccagctactcgggtggctgaggcaggagaattgcttgaacccagaaggtgggggttgcagtgagccaagattgtgccactgcactccagcctgggcaacaagagtagaactcagtctcaaaacaaaaaaaccccacaaagcaaaaacttcaacctacagctaacatcacatgtgatggtgaaagactaaatactttcacctctaaaattaggaacaaagcaatgctcttatatggtctagatgtactatatgtactagaggtcttagccagtgcattaagacaataaaaagaactaaaagcataaagattagaacaactataattactcccaagaagcatgattgtgtatctagaaaatcctaaggatccaaaaagctactaataaatgaatttatcaaagtctcagtatacatgatgaatatattttaaaaaatcaattgcatttctatatactaagaattagaaaatatttttaaacatttcatttataataacaaaaaatacttttgtcatgaattcaaaaaaagttatgcaaggcctgtctactgaaaactacaaaacactgcaaaagtaaattaaacaaaacccaaataaataaagaaataaaccaggttcacggattgaaagactcagtagcgttaagactgcagttctctctcggccttagcgccatttttttggaaacctcggcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcaaaaacaaaatgcccatgttggtcctctgccctggacctgtgacattctggactatttctgtgtttatttgtggccgagtgtaacaaccatataataaatcacctcttccgctgttttagctgaggaattaaatcaaaaaaaaaaaaaaaaaaagactgcagttctctcctatagattcaattaaatctgacctatagattcaataaaatcccaatcaaaactatagttttaaaaaagttgacaagctgaattaaaatgtatatgaaaaggcaaagaacctagccaaaataacttctttaaaaaaagaacacactggaagaattctacctattttcaaaatttactatagagctatactcatcaaggcaatgtggtattggcataagaacggacatatatacatttatgaaacagaagtgagagtatggaaatagatacagacttataaagacaattgcttttggcaaaggtaccaaagcaattcaatggggaaaagacactcttttcaaaataaatgacaatggaattagacatctgaaggaacaaaatgaaccttgaccctgacctcacaccatgcacaaaaataacctgaaatggatcatagactaagagctgaaactattgaacttatggaagaaaacatgagaaaatattttgatactgtgtttggcaggacacaaaactcaggaaccacagaaaaaaaactgataaaatgaacttcatcaaaataaaaaacttatgcttttttttttttttttttttttttttttcagacactctgtcacccaggttggagtgcagtgatgtgatcttggctcactgcaacccatgcctcctgggttcaagcaattctcctgcctcagcctcccgagtagctgggattactgacgtgtgccaccatgcccggctaagtttttgtatttttagtagagatgttagccactgtgttagccaggatggcctcaatctcctgaccttgtgagccgcccgccttgacctcccaaagtggtgggattacaggcgtaaaacttctgcttttctaaagccacagttaagacaaaaaaacaaagcacagactgggacaaaagtttgcaaaacgtatttaacaatgttgtaaccagaacatataaagcactcttatagctcaattataaacaaaataacccaatttgaaaatgggtaaaagatttcaatagacacatcacaaaagaaaatatgtaagtgacacatgaaaagatccattactagtcatcggagaaatgaaaattaaaacgatatagtactacacacccactagaatgaaagaagtctgacagcactaagtgttggtgataatatggaacactgctggaggcaatccaagatggtgtagccactctgaaaaagtttggcagtttcttataaagttgaacatatacttaccatatgacccagcactctcactcctattatttgttcaagataaaggaaaacatatgctcgcacagttttgtatgtgaatattcatagcaacattatttataatagctaaaaattagaaacaacctaaacttccataacagatcagtctaagttttgatatatccatactacagaatactgttcagcaataaaaaggaaaaaggtaggccaggtgtggtgactcatgcctgtaatcccagcacttttgggaagccaaggtgggtggatcacttgaggtccggagttcgagaccagcctggccaacatgatgaaactccgtctcaactgtaaatacaaaaattagctgggcatggtggcaagtgcctgtaatcccagttactcaagaggctgaggcaggagaatcacctgaactcaggaggtagaggttgcagtgagccaagatcatgccactgtactccagtaagggaacagagtgagactccatctcaaaaaaaaaaaaagggagaagtatatgcaacatcatggatgaatctcaaaaatattatgtaaaagacatacgcaaaagactacacgctatgtgattctatttatataaaattcttggccgtggctcacacctgtaatcccagcactttgggaggctgagggtggatcccctgaggtcaggagttcgagaccagcctggccaacatggtgataccccatctctactaaaaatacaaaaaattagctgggtgtggtggtgggcgcctgtaatcctagctactttgaaggctgaggcaggagtctgaaccagggaggcagaggttgtagtgaactgagatcgcaccactgcactccatcctgggcaacaagagtgaaactctgtctcaaaatagatagataaataaaaattctagaaaaggcaaaactacagttacagaaaagcagatcaatgactgcctggggttgggctgagaagaagacagattacaaaggagaacaaggaagctttataaaagtgatgaaaatgttctatattgtgattatggtggtagttatacatctgtatgtaattacaaaaattcatcaaactgtacacttaaaatggataaattttattgcatgtaaattcagctcaataaagctgggggaaaatgcaaaaatatgaataaagttacttacaggtctcgcttattaaagcagaacagcactcccagaagagttgtcaataggaatgctaagcaaacaggcacgactatggcttcaatttctccttgagcttaaaaaaaaaaaaaaaaaaaaaaaaagaggtgtgatgggaaataatgttgacatatgaactaagaagacataatacaacttcccaaccagacttactgttgaaaagataaaatacaatcctaattatttttcaaggtctcttcagacttgatgatttttaccctcttctctctttggtaaatcacatcccaaccatttatgtcttatacattaacctggccgcatagcataaaatatatgttggttgggggataaaaatgatcagtgtatcgggtaatctactgggttagagctttcaaacataaccatttgtaacatttatgatctgcatttggtagaatcttagtaaaagtttatctctgagttctaatactgtataacagagaaattatgtcagaacaaatataaatactgggtaaaatggaaaagctataaaaacataattgaactacacatttaaccttctaaaaaataaaaatgcaactctcagaagttttaagagttatttaccatttttcaaaaggaggatatagctggtacagggctaagaactttaggagctgctcaatgggcatgaggagtggcacgagtaggaataaactaaaaagtaaacaagcctaagatccctaaataccacacaaatcctcatctgcatttaaaagaggacttgttcatcaaattaatcactaattgggataattaacattggagattttttaaatgactgtcctgattaattttgaattttacttagtcttttacagtaaaaaatgtatgaaagtaatattgcagccatatactattcacttaattttatccttccaccacacatatccctttgtaagtaactaacatcctatgaagctcagtagaaatcaagaaatcagttaaatgcttgagaataaactatgggttggcaaatattaactcttaaatgctaagcatcatatatatatatatatgggtgtatgtatatatatttatgtgtgtatatattgatatatgtgtgtatatatatattgatatgggtatgtatgtgtgtatatatatataaaatgccaaatctaatttaggcagaaactttgctttattaaacatctgcttttatgttttcaagcctgtgcctttgctcatgctgctctctaagatgccaccttcttcctatttgtccacatactaactcaaggctcaagtattttcttcttcataaaacctttgaaggtaaaattatccactactggtatatttaaattcctactctatttactgtctacatagtccacaggttctcctttttctgatttacttatgcaaaatttcttcaactaagctgtaaggtcctcgttggcaagactcaagccatgtgaagaagccataatggatccatgagactacagatagagaattgaaaaaaggtaggttataaaataatactaagtataatttaattttaggaaaaaaatatatacaaagaagacactaaaaggatacacaaatatgttattttggggtaagggactaggactaatttttcttcctctctacattttactgtacagtctaaattccctataatgaacacctatgtaataaaaaaattttaggctgagcatggtggctcatacctgtaatccggcactctgggaggctaaggcaggaggactgaggccaggagttcaaaaccagcctgggcaacacagcgagatcccatctctaccaaaaaaattgttttaactagccaggcatggtggtgcctaccagcagtcttagttacttgggaggctgaggcaggaggattgcttgagcccaggaatttgaggttgcagtgagctatgactgcaccactgcactccagcctgggagacagagcaagactctgtctcaaaaacaaacaaacaaaaaatatacatatgggcttttatgtgtgtgtgtacacacacacatacatatatacaaagctctgtagagatggctggtctccacagaaatacataaaatatacatttttaagtttattttttaatttttctcaagattatggtataaagttttattttaaataacatacctattaacataccaccacatgggaccaaccttatcccagaaactatattcattactgaccctaacagcaaagctcaggaacttttatcatttattttatgtagtcactcattcatttattccctcattcagcaagcattcaaccaacaaggcacatggaatttactacttatcattaactaggctggcacttgggggtgggggttacaattatggtaaaataaggtaattttctataatgattcaaaatgtagggggagcaagaaagaatgttggttaagtttgctttagggaagatacagaagagccagatgatgaggtgaagacctcactgggggcaatgcactaagaaaagagaagttagcatgaggagcttgcagttgaagaaaatgatgatgaaagggtacgcacaatcaacaggacttgacactcagcttatgtgagagaaaaatatacaaatacatttattgtaatcacatttaaatttatggctttggcatagaacgagggagggaaaatgtatttgggaaggaaagagaagatggctaaagccatggacagagtttgaataggcaagtaagaaaacagggtcaagaggccgggtgcggtggctcatgcctgtaatcccagcactttgggaggccgaggcaggtggatcacctgaggtcaggaggtcgagaccatcccagccaacatggtgaaaccccgtctctacaaaaatacaaaaaattagccaggcatggtagtgggcacctctaccccagctacgtgggaggctgaggtaggagaatcacttgaacctgggaggtggaggttgcagtgagctgagatcgcaccactgcactccagcctgggtgacagagcgagactctgtctcaaaaaaaaaaaaaaaaaaaaaaaaagcaaaaaaaggagaagaagaagaaaacaccaaagaacaaggagactcaggagactgtgctagcagaaaaagtatggttagaaaacccaagggaggagggagtttcaaggatggaaggccaacagagtcaaatgcagaaaaggctggaggcagtggcttatgtctataatcccagcactttaggaggccaaggcagaaggatcacttgagcccaggagtttgagaccagccatctctataaaaaaaattagctggatgtggtggcactggtcccagctacttgagaaactgaggtaggaggatcacttgagcccaggaggtcaaggctgcagtgtgccatgttcatgccattgcactccactgtagcctgggcaacagagtaagaccctgcctccaaaaaaaaaaagtagaaaaaagatgaaaactaaaaagcatgcagtacatatgatgatcaagaggtcttctgagtgacaccagagaggtttcagtgcaggggtggggtaggacccctaatttcagtatgttaaatactgagtgggaggtacggaagtgaagactgtaaagtggactagtccttcaagtaatctctcaataaaagaaagaaatgaggatagagaaggaaagaacacacccaaaccagtgaaaaaaatgaacccacatggaaagatacacaaattcttttaggatttttagtacagctgaatatagtcagaagcagttaataaaataccaaaaaggtgaggaataacactttctataaagaaaccaccaaccaaagccagataatataaaaatcatcatgaatccaaagatgtactttttaacacaattttagcacataaactaagttcatttctaacctaagtttgagaaagaaaaaaaaccaaacttcattatttcttaccaaactttggggtagtaaaagtgaattctggaccatccttcccaccttcatctgtgtatgctgccattcgtaccatgtacaatgtgtcactagtcaaagaggacaatgtatattctgtgtgggaagaatccacattcacagctggaagaaataagaactgtgcttcattcaactattcaatgcttttgcttatttggcctatatttggcattgtgaaagtgttaaaaaagaagcgaagtatttttgttggaaaacaacttttataatgttctgacataattttatgttctaaagcacaacacaatactttttcaataaatccatgaaagtaaccataaggcaaattctcaggtgtctcctgaggccaatatactataagatgtataagaagaacagacttaaattagtacttaaa

SEQ ID NO: 32 - DNA, 150235 bp, Artificial Sequence
  Synthetic BAC sequence
atccctgagtaacaaagcattctgacactgataagcacttctcatttaattctctttgacttgtagtgtttatcttgctgttacttgtagcaaagtttcgtttcagcccctatctagccctttacagaaaaagtctgccaattccaatttgggacttaagtgaaaaactgggaaaccagaaaggaggaaactaggcttttctgtgatttcctggcgccacactttccgatgctcacagcaaggctgcaatctgagcaggtgatgccggagcaccccaaactctatactgacaagtgtctctttgtatgacagccacagagtgcccacattcagagatactacacatttcaataacatgacctcattttataacagatgcgggcaacgttgcagagaaaagggaatgcttatacactgccggtaggaatgtaaactacttcagtcactgtggacagcagtctggcgatttctcaaagaactggaaacggagctcctactcaatccagccagcccattattgggtatatacccaaaggaatagaaatcattctaccataaagacacacatatgcatatgtttatggcagcactgttctcaagaccaaagacatggaatcaacctaaatgaccatcagtggtggactcgataaagaaaacgtggtacaaatataccatggaatactatgcagctataaaaaagtataagatcatgtcctttggagcaacatggatggatctgggagccattatcctaagcaaattaacccaggaactgaaaaacaaatactgtataccctcacttataagtgggagctaaacattgagtacacatggacacgaagaagtgaacagacactggggcctcttgagggtgagggtcaaaaaactacttctcaggtactgtgcttattagctgggtgatgaaataatctgtacaccaaaccccctcaacacacaatttatccatataacaaacctgtatatgtgcctcttaaacctaaaataaaagtttaaaggaaaaataaataaaataggacctcattttacctctaagatatacttcatccgggtaaatcttaactacctcaacaacagcaataaatttttcaatgggtgcctctaatttattttaaattatctgtattatcattgttggagagcaattttttttcttgaaactaaaaattcaagctttcactcatggcctagggaaaaaatattttgccctctgtccatcatttattacctcatattctgagtcagagacaaaaaccagttttccccactgtcttctgcttcctgcctcaagtctcaaatctctgttttgcaatgttttcctgaaacatgcatctgctggtagcaacgtcttgacaagggcagcccagtagacgagaataaacacaatcaactggcatgtaactcaaggtcattttgatgagtccttgctctagacaggtgtcagcaaactgtggctcaggggccctgctgctgcctgcttttagtaaataagcttttactggaacacaatcacacccatttctttgcatatggcctgtggctgtgctcttgtcacaaggaggacagatcttgcatccaacagcagagttgagtggttacaacagaaaccatctgggggccgggcgtggtggctcattcctgtaatcccaacactttggaagccaaggtgggaggatcgcttgagtccaggagttcaaaactagcataggtaacatagtgagaccctgtctctacagaaagaaagaggaggggagaggggagaaacttggaaaaatgaatcttcagcctggcgctgtggttcatgcctgtaatcccagcactctgggaggctgaggcaggtggatcacctgaggtcaggagttcgagatcagcctggccaacatagtgaaaccccatctctactaaaaatacaaaattagccaggtgtggcggcgcatgcctgtaatcccagcctactcggaaggctgaggcaggagaattgcttgaacccaggaggcggaggttgcagtgagctgagatagcgccattgcactccggcctgtgcaacaagagcgaagctcagtctcgaaagaagaaaaaaaaaatcttgtctgcaaaacttaagatgtttatcatctgcccctttacaaacaagtttgatgacactggctccagaaagccaaaaagggaagctagactcttctgatatttccttctgatatttcctggggccttgctttcaggtgcttaaacaaggcctagacctgaacaggcaaagcaggtggacccgacgctctctgttgtcgatttttatttgcatgatagccacatagcgcttgccttctgagaccccttcccccagtctttcaggcatgcactcactgggcaagcttgcatcctcctgctttctgagcgccttcatttgttcagggatttctctcccctaaccagatggcaagccctcagaggccctctgggtcccgcagctcatgctgagctttcctccaggctgctcggtgaatctgactgccttctttgatctccgtcgtttaatttttgtttgtttgtttgtgacaaggtctggctctgttgcccaggctggagtgcaatggcgccatcatagctcactgcagtctcgacctcctgggctcaagccatcctcctacctcagcctcctaagtagctgggactacagatgtgggccatcatgcctggctaattttgtttatctttttggtacagatgaggtctcactatgctgcccagcctcgtctcgaactcctgggctcaagccatcctcccacctcggcctctcaaagtgctgggattacaggcatgagccaccatacctggcctggatcctctcttttgaaatgtggcagacccacatagtctgaagaaggcagctacaatatcacactgttggacatcactggacttgacagtcacccagcttgcccgagccactttgcctcagtctacatttctgccatctgcacgcacactcggatgtcacttgcccgatccacatcatgaaagggaaagaagtttgcctccccatacacgcccaaggagtgcttagtgttaaataataaaacgttgctcaataattctacgaatcaaagcagaacagcttcgtgagtttttcacaatactagcctgctggctggcacctctttgagtaggtgacatctgtgtgcactcacctgagtgcactgtccttcacgttacttggtgacaaaaacagagcctcaaagcttgaaaagtggtctacagaccaccactgtgttacggtccatatgtgacgttacagagaagtggtttaggtaaggctgacctgggcttgaatcctaactttcctacttataactttgtgtatttcagcataattacatcattttcctggtctccaccttcccatgcataaaatagggagagcaatgtttacttcactggatggctgaaagattaaatgaagaaatgtacgtaaaaccctcacagcacttgatacgcactgatcactcaatggtaactactgtgcctcagaaaaatgcaggatacatttattgtttgtgggctggtagtttggcagcaaatgtcattacccactgtctgtgaagagttgggaatgcatattgtaatgatcaaacacaagatgttccccaagtccatggagcttacaaattactcacctgtaaggttacacatgaaatatccaaatagcccttgggaacccaattttggacagcgagggagaaaccaatgtcctagagcataaagtaagcctgtgagtgaaccaaaatcgacatgcagatcccagtcctcctactcgttaattcacgtttgccctcattttaacttgactaattcacgtttgccctcattttaacttgacaattacagataagaaacatgcttgttctttaccctctaaatttgtcaactaaataaaatggagaaaggaagacaagcttcaaaggctacgtgggaacccagaattggcacagagggacacagagtgtgggaacaggtttgaagaccattaaagcatggaaaacatctggtaagtgatccattcgtcactgcttggttgccaaagagggtcccttagccaagttctttaatatgaatgtgaaagtagtagatctaattctatagatcagggaaaggaaagacaagaaagtggacaccatggtcaaggaaaagcatattcttaatcctcccaaggactacatgtctgtctgcaaatgtcaatgctttaagcatgcaactaacaacaaaaaaaagaagccttccctgattacatttttctcccccctccctttcttttttttcttttttcttttttttttttttttttggctcttctcagctcccattctcaccaagaagttttagctcaaactgggaggtagaaaccctgcctgacccaacaccacagccatctctcaacaaactcatctgcaaaagcacacgggagggaaaacagcaaagccacgtgccagcaaacctcaggcagctctgttgctgttcccaagccaggcaggtcctggcttccaggatcatgttcccactgggattaggacaagaaccagaaaatgccagaggcacacagctttgggggctccccaggtgccaatataccccttaccgagaatatttttttaaggttgaatggtctttacagctttttctaaatcaatagttcaagtaattattaaatgccaactatgtgtcctacattgcaataaatgcagcaaggtctttcaggcccgtcaaagacgaggggagccaagaacattgggaataacagtgaatgattcttaatagaatccatgtggatgcatgacaaatgtcccacattgccaagcctgttgacacaatatgaaaagccctttgcttgggataattgtcctcttcaccaatagacataacatcatatacaagactcttcaaagagccagctaagcttttcacttagtactgtggccttggagatgctgagaactgcaaaaatagtccgcagatttcaaaaccactcaaggcagcgaggggctttcaaaattgctcagacatgtgtttggctggtctagggtggctctcctggaaagaggccatgctgaagcttcgaagccagcagagtgcatgccagactttcagtggctagcaaggaatggaattttaatatccaggaatgaaggaagaggggagaataacaaatgatctgacatctgttattacattgctcttgcatcatgcgaggaaatccctgccttctgcaatgcagccttctcagttgggtcttcaaatgtaagactgccttgaccttgtatccatttgcacttctgccagctgcatacatgtgtgccttcttgccgcaaccacactcttacttgcacggtacatggcttagttctcagacttcagacctgggagtaaaggctgccaccaccatttattagccaacttatctacctttgcaaagcctcagtttctccatcagtaaaatggggatgacaactaaattattttaaagattaaagattcttgcattaaatcattcacataatactcttagctattttggaaatggcccatgccatatttttaagaagtgcccgaattattttatgattaaaggtacatttaggagaccctaatttagttcattagtttttctctggataatttggggcagggtttatttttctgagggttatttggcaagaagattcttgatcattctcccacaggaagtggaagacaaccctggggcactggattggactaggtttgaggttaaaccctgaagtgctctggcacctgagatgcatttctttaattactaatatgcttgatggttttttcataattttatcaaatcatcttatttctttctagtagcttgttttatatcctttgctcattttcttatataggattaattttcattaatctggaacagttctttacatattaatgatacacttacttctttttcctgcatgcaattttctagtgttttgtttacttttttttgtttacaacaaaaatttaaaatttttatgtagctaaagttaccgattttcccctttgtaattacttttaggcttaaaagtgattatactgcttttaggcttagaaagtttcttcccacttgaaaatcagttaaatatccacctgcaatttttttttttttttttacatattttggggtgtggttcattgattaccttaagcctcttaacccatttggaaatcttagcctagtaacagttttaaatgttataaattggcacagactttttagaaaatgtttttggaatgtgtaccaaacccacaaatgaattggtactctttgccccagtaattccaattctaagaatctaatttaagaaaatgacagggcatgcgtcaggcatttctacatgaagacagtcatcccgatggggtttattatcacaaaaaatggaaatggctgaaaagtctctaatgggtggtagggtgaataaatgttctgcagctacacgctcccatatggttactattagccatatattaactatgcaaatttaaatttattaaaattaaaaattcagttcctcacttccattagccatacttcacttgctcaacacccatatgtgactagtggctattgtattggacagcacaggtgtagaacattcccattctcatagaagcttctagtgaacagtgttgctctatggccattagaatcaggtttttaaagaatatttaatgccataagatatattcataatatgggggtgaataaaaacatcagaagacaaactattcggtagtcacaggaattcagactggttgcagttaatttaatcataaatatcttcagcaagttatgtttgttcagaggaaatacaaaccctgcccccacaaaaaagctgtgttttttttttttttttagaaaggaaaagaaagaacatctgaagattcataggtacctaggaattaaatgagatgcctgaggaaacccagcccatggtaccctctcagtaactgttaagtgattcaaaatccaaatggcaattatcatactgatcgtatgtaagcctaattaacacggtattctgtgatccacagtggtcttaaaagaagccatggttattcttctgtcagcatcgatcatgcagccatcaatgtcacaaaacaacttggtcaacgaatggcatttaagaacttgtagtacacagggccgggcgcggtggctcatgcctgtaatcccagcactttggaaagctgaggtgggcagattacctgaggttaggagttcgagaccagcctggccaacatggtgaaatcccacctctactaaaaatacaaaaattagctgggcatggtggcgagcacctgtaatctcagctacttgggggaactgaggcaggagagttgcttgaacccaggaggcagaggctgcagtgagccgagatcatgccattgcactccagcccaggtgacagagtgagacttcgtctcaaaaaaaaaaaaaaaaaaaaaaaaagaacttgtagcccataatgcgaagaacttcacaaggtatttggtaaataaggaaaggctatgtggcctctaaaacatcaataaatatcagccactataagagaaagcttcactttggtgtaacaaaaactttgggaaaaactttgggaaacctacaagtaacttgagccctaagggactccaaagtttggatttcgcagacacagacaagtacatgtttactgtgcttgagaaaatataaaagattaaaaactgtaaaaaacggaaaatcctaaaacatcacagaggagatttgaaaaagaacttaaatattttctttagcttcccagtaagaactaaaaaagctaaacaaatggggttttaaaaaaatctttaaagtagcagaaagcaaacaaaacagtgagaaaaaaaatctgagagaagatgcaaattttaagaggtgagctcagcatttgggaccacttgtgtctcaaggatgtttgtcaagaccgaagagacacctgagaggccgcacatcccctctgtagcttaggggtgctctggcaaatctacactgtgtgcaaagcagaaatatgccagctcctaagagttctgcagtccagcttcgtgccatttgggctgcccaaacacctccatccctgaaaatggactaaagtaatcccagatttttattcccccagagatctgacagaaacaagcccaaaccttctctagaggaacagaccattatcttaggcctcaaactatttctacaaacagattttcaaatattatgttcatcattcgatgactgccagtgtagaataccatacctagtaaaaactatccttaaaggataaaagtaaaataaatcattttcagacaaagacagagaattatttttaaaaatacgctcatggatgatgttcctcatgcaaaagaaaaggaacccagatggaaagtcaagaaagcagaaggaagaaaaagtcaaaaatggagcagttggcaggttgcgctctggacgagcacgtgatgttaaagaaccactaaaagctgattcacagagcaaggttattttccccctacattagttcgacattatatttggctatcctctaaaacaagcttgtccaacccctggcccacaggccacatgcagctcaggtcagctttgaatgcagcccaacacaatttcataaactttcttaaaacatcgtgagatttttttgcgtgattttttttttagctcattagtattgttagtgtgagtgtattttatgcatggctcaagacaattcttcttctaccagtgtggcccagggaagccaaaagactggataccccggctctgaaagacaatagttaaaccctagtctcacttcatattttgaaatatgtttttgctctattggagtgtaggaaaaccagatgccatgaaaaaccagaaagccatggaaaaccatgaaagccatgaagatacagatttcactgccagatttttaaaatataaatggccaaagaagccatttataaagtagtagattgagattgagaaaaaatagttgcaacagtttatcagctaggagtaggttcaactgcgtgtgaggcaggacctggaggtggacgcaggttggacagagagtttctatgagatttgagatagtatctcactcattaaatcacaaatgcattgtgaattgtataaaaaaatgaaaaaggccgggcatggtggctgatgtctgtaatcccagcactttgggaggccgagacaggtggatacctaaggtcaggagttccagaccagcctggccaacatgatgaaaccctgtctctactaaaaatacaaaaattagccaggtgtggtggagtatgcctgtaatcccagctactcaggaggctgaggcaggagaatctcttgaacccagaaggcagaggttgcatgcagtgagctgagatcacgccattgcactccagcctgggcaacaagagcaaaactccatctcaaaaaaataaataaaataaaatagataatgaattttagaagacaaactaacagattcatgtttttgaagaatgtaaagatattagctggtctggcagccagtagctctgttttctattatgtgagtttgaaatgtatcgtatatgaaagattctgacatttatgatagcagaataagataagaaagtcttttccagtggtttgtaagaaaagcataaatagtcatattttcaggaatctaatttttcgacataaactacgtgacccctgaatgtctccccaccaccctggaattttaagattcatcctaaattttgtgacatcagtcctgacttactgtgacctgagttctttattctaaggaggcttccaatgattctattccactgttctcaaaggaatcatcgctgaacagaattactccatcaatgatagtgctgaggactggccctgtcgatggattcctgtctcacttacattatccactctgccagtgctgtttatttcaaggggtttctacagcacgtccctctgctctcttaaaaccaccacgctgaaatacagtttatgtcaaatgacttaactgaatccgctcaagaaggctttccataggcaggaatcgctggatggtaaagctgacgtttggcatctaccgaactttattcgcaaagcaagtcattgtcccaggcaaaagcgagagaggaataaatgggcggttggcactcactcacctgccggagtttggttcccaccatagaagcactgctgtcaagcacgaataccacattcttgggtaaaggaggaaggtctttaggagcaaagtagtgcacaaaatagccatttagaacctggtggagggaaaagaaagtaaaaacggtagtacctagagcggggagcaaaaatacctgaagtgggtagtctatggaatttctaaaagttaaagcatgacaaagagtttagggtgagattccacacccggagtaaaattatctaaggccctgatccctccaagagaactaattgctcatttaatctgtataagggtagactcttccctttaaaattgatcagtgatgactaccagttcaagtttaattatccatcccttggacttttgctacttgagaattctgcttccttcattatgttttttttaccaagcatcttacaagttgagacatcaagattctctacattctggatgcaattaataggttttaatatccccaccctgtctctggaacaataagacctaaagggaaatgagcagcctcttttaattaaaatggaacatggaccaagcgcggtggctcaggccggtaatcccagtgctttgggaggctgagggggtcagatcacctgaggtcaggagttcgagaccaggctgaccaccatggcaaaaccccatctctactaaaaatacaaaaattagtggggcgtggtggtgggtgcctgtaatctcagctactcgggaggctgaggcaggagaattgcttgaacctgggagacgaaggttgcagtgagccgagatcggccactgcactccagcctgggtgacagagtgagatttggtctcaaaaataaaataaaatggagcatgaactaaaattctaatttcatctaaaacaccacagggagctttatattacagatttcacttgcgctgcagattactgaagctggaaataggttccctcagcaaaaaaataccgctagtctctttgaagaaatactttggattaaaacaaatttactaagaagcagaaagttctctctcccttaggtaaatattgggatccacagtatgagtctgtccaaagtaccaaccaaccaacatgaaatagcaacgacgatcctattacctggatgtccccaatgctctgttctctattgacgtcatatctaatgataaagtctcccaaaattccattctgggcaatcctggcttgttgtactacagtaggtttaaaaattatgttggcaaatgtttcattttggttaatgacagtagatgggggaggcccagaatcatctgcaaacaagatagaaacataattaataacttaatatatatttttccaaaaagaaataaaaactgtttggcagacacagagttttagatttcattttattacaggcttgtatttcacaggaacttctaagactgtactcatatatcacaatgcgagagttatgtcatcatatagtttcctcttatgcctctttttgaaccttttcttatgaacatttttaaaacacacaaaagtagagagaatagtaaaatgaacccctgtacccatcacccaactttaacaaacatcagcatgttaccaaccttttgtatgtttttatctattccccattttttcctagagcattttaaaacaaattccagacaccatatttcatccataaatactccagtatgtctttacctgtaagaactcttttactaacataaccacaaaaccattatcacaagtaacaaaattaatgctcaatgccctattattatctaattctcagtttgtatttaaatttatctgattccctaaagaaagggtcttggtatggttgatttgcttgaatgaagattagaagagtccccaatcacattccatttttatttcttgcttcttttaatctccagtgtctgcctccacctcttttgtgatgctgcatatatgtgataaatcgctggtcatttgtcctatgggatttctctttttctgtattcctttttttttttgagacagcgtctcaatctgtcacccagagcgcaatggtgcaatcacagctcacttttggactcaagtgattctctcacctcagcctgccaagtagctgggactacaggcacacaccagcatacctggatcattttttgttgttgttttttgtagagacagggtcttgctatgttgctcagactggtcttgaactcctaggctcaagccatcctcctgcctcggactcccaaagttctaggagtacaggcgtgagccaccatgcccggcttacggctcattaaaaaaaaaaaaattctcaaagctttttcacatgaaatttaggatataaattagaattacagaaagataaacagataaatggatattatgtaatttatgaaaacctagtgtgatgacagattaagcaaagagcatcccatcttttagtcctgaccttcatttcctgttagaacacagagaattatttagcaaactactcacgtttataaacccaaacaacaccatatctatgtacttagcaataaaaccccaaaagatgaggtctgcatgcaccctggagaacatgaaaacataaacaagaattcttaatcataagggcatgtggaggctttttatccagatattgaatcaaagccagacttaaaactgctgcaaagcctctgattatctttttaaatgtactcaagttgatagcatgaaataggctgaccagccatttcccatctccaattagcagaatgaaaaaggaaatgaggcgttaagtggccacagtaatttgtatttaaaaataaacttccttctgctgagggtttattagacacacaagtcaaaggaagtttaaacatttcctttaacaaaataggcaattatttttcagagacaatttaggtgtaaccttaacaggaaccacaaggtagaacagattcttctattatttgcacttatcaaggacagggattttggaagtgatcagagagccagcaaagagaaaaggttatttttgtagggagacagttacataagagagaacacgagtccacagatctgctcatctgaaggagttgggaaaatccagacagtgcatggacaggtggcacagcccaggtcactaccagcatggttgaagatgccttagacccattagacaggacaaagaaacgggtgctgaaaaaggaaaagtccttgaaattaaaggaaactgcatgctgtccagggtcaatctctcattggtggtcattgttaaagcacccagagtgacaggcatcataatatatcagctaagaacgcacgatcatggtcagaaacctgcattcaaatattggtttcacttcttaacagctgtgagactttgagcaagttactcggccttggttatctcatctgtaaaatggattaatgatagtaccaatctcacagtattgaaaagatcaagtgatgtcacgtacttagcaccattttccagttcacagtcagcagtcatgctagcttatatcattactgtatcagtccattttcacactgttatcaagaagtacctgagactgggtagtttatacagaaaagaggtttaattgactcacagttccgcatggctggggaagcctcgggaaacttacaatcacgcagaaggcaaacgcaaagcgaacacgtctacaaggcggcaggagcgagagacagaactgggaagcgccggacttttaaaccatgagatctcgtgagaactcactcactatcacgagaacagcaagggggaaattcacctccatggtccaatcacctcccaccaggccactcctccgacacatggggattacaattcgaaatgctatttccgtggggacacagagccaaaccatatcaatttccaaccttaactatataaaatagaaggaggggccaggcccggtggctcacgcctgtaatcccagcactttgggaggctgaggcgggtggatcacctgaggtcaggagtttgagatcagcctggccaacatggagaaacctcgtctctactaaaaatacaaaaaattaggtgggtgtggtggctgtaatcccagctactcaggaggctgaggcaggagaatatcgcttgaaccagggaggcggaggttgcagtgagctgagatagtgccattggactccagcctgggcaacaagagcaaaattccatcccaccaccccctacccccgcaaaaaaaaaaatagaaggagcaattacatatacaactataaacacaagtcaaacttgggataccacaaggcaataaaaacaaaagaactaatattgctatttagaacatggttgaacctcacagtcttcttgagtgaaaatatcagatacaaaagcgcatgttctctctgcttccatctgcataaagttcaagaggagcatgaaatacccatggcaactggagtagaacactgctgacctttgaaggcctgctcaggaccaggaaagagcacgtggtaattttgaggaagggtgaaaatattccatgtcttgaggtggaaggcagttgaatgagggtatacctatgtaaaattttatcaagctgtacacatgacatttgtaccgtttatggtgtatgtacaccccagttattaacatttaaatttattgttagcaaagtagattaaacaggcattccccggcatggaacataacaatgttatttgccaaacagacccctctctgtccttctccttaggatgaatgtgcatgggcatttattaaatgaggattaggtgtgtccagagcaattccagccggcagaattaggaccagggagagagtttccgggaggcacttttcagcgcagtgtcggtgaaccctaagaaagctgtcctgttgggatcggccgccttcacaacccatcccattagaagggctcaagtgaaccctggaataatcccccccacgagggtgtagagcagttctcacagtgtgatcttgaaccagcagcatcagcagctcctgggaacttgctagaaatgccaattctcaggcccaccccagaaactcggagtcagaaactctggggatgggactccgccatttgtgttttaacgagccctctgggtgattccggtttttgcccatagaaaataggcatgtagcttacacatggtctgtgtgccttacacatagaaaagtgtcaataaaatgtgttgtatgcaattaggcagcacttagattatctctaagattctacaataattagattagactctctttatgctgccagcatgtacctacttagtcttgcttccaatctcgtgaaaatgctttttacaagctccctgaattaataccattcatggctgagtaaaagcactggggattagaaagtataatttctctgtccatcattcactcgactaggctctttgatatggaccatgaggaaggatactgtatgattattttggcttcctagtgacctctggttttactagctcatgatgaaaattcatgagattcaactaaatgggattattttacacacccaaagaatgggttgattctcagtttggttactcaccaaggagcctggttcctgaggccaaccaccacccaggaagaagcagacagtaaatgtgacccaataaatttttcactactttttttttaagtttactgggagcaattccagaggagcatctctagaaaatagaatcatctttttattaagggggaaaaaaatctgttaagtaggttcatatgggctgttccaccgttactgaccaaaatcccagagcagaagaacatgactccgtttttccttgctgtgaatgggggctcaccctgcttaccgccacagatatttcctaagcacaaaaatgagtgtcacccgcagggtcatcagagtcacaggttaatgaagaccgcaaggaaagacattggtgcagaacaaaaaagaggaagaatctgacccacttgtctaatgagaacccatgtctctttcctccttcgtgttctctccttcttgcccacttctatggtgagctggagcagctgctccgatttgagggaggccaagtcttctaatcccatcttcctgtcttcatgcaggcattggtgatcccatgcaagacaaccccagggacacacaactgcctctcctgccctcgggaaaattcattcatgctcttcctccactcactgactcttccctgcctctcaggccaccaggactcccagggggctctcttcttttctaaagcccagtattttagagcaagaagttttgtgttatctttgcaaactacagaataccaaagagagtgggttctagagtgtgactgaatcaaaacgactgacttaatattcctgagcttcagtcccacatctgttacatggaaacaattccacagtcacagaatcattgttgagatgtagtgagatctcatatgtaaggtaccccgtgtggtgcctggcagacagtaggtgctcaatacatactagctccatcctcttccccttcagaagtagttttttgtactttgtccattatgaaaggcaacttataaagaaaaaaatgctcttggataacatacagttcacattttgtcataacagttttctctataccactgaaagcttgaaaaaaacaatattttaaaaggacagacacataataaacattcataacaggaaattcaatatatatacacattatacatatgtcaatatgcttatataaagaataatctttaaaaaaagaataatctttacaaaatataatgaagtcagtagctgtctgaaagtcccttaaaattatacacagaattttgcacgtaagcgtaaatgtacatttttttctgaagaaaggatgcattgattttgccacattctccaaggactctaaagaaagttaagaaccatgtttataagtgccattaaatattcctatgtctgatcctattaggtaatgacaaagtactttatagcttgtgcatcagagttgaagagaacaaaacatatgtccttagtgatgtcctgatacatggaggttggtcgcaaacatacaatcttttcctagacaattatcacatggggaaagatggcagccaactgctatgtaaaatgccaaaggtgaaaagattgagaagagccccatgctcacagccacgggctggaagcgccaccctctgggttgatagggagagggatttcctggcctctgtttcctgagggtctgggttttggctgctgtcggagaaaagcagccaacacctggtgcattgacaaaaggatttcccaacacacgctgcctgctcatttcctctttagaaagaagcttaaattgtctatgtttgtttatgaaccctgcttacctgggatccaacgaggcaatttcttaaatatatggaggtcaaaaatactgtgaataattggagcactaccctctgagggtggcaataaagataaaactcaagcaaatcagcagaggattgaaagaaaaactggtaacacagaggcaatgacgatgagaaggaatttggttaaataccttcataaggccgggcgtggtggctcacgcctgtaatcccagcactttgggaggccaaggcaggcggatcacaaggtcaggagatcgagaccatcctggataacacggtgaaaccccgtctctactaaaaatacaaaaaaatagccaggcgtggtggcaggcgcctgtagtcccagctactcaggagggtgaggcaggagaatggcgtgaacccaggaggtggagctcacagtgagccgagattgcaccactgcactccagcctgggcgacagagtaagactccatctcaaaaaaaaaaaaaaaaaaaaaataccttcataagtctcttactatccacagttttcctttgggaaaggatttttcttccccctacgtgaatgtttggtattttaaatccttttggaaaacagcatcatatagatatgatagcaacacatagcacagaatactaattcaaatttatagctgaagggattcaaactcaactgtagtattttatagttaagtagatgtttgcccaggtttcttagcaaatcagctttcttcactgcttattcaatgctcttccttcctaaaataatagattcccaactctcagttttccatatttgaaaaaatttcccaagagagactatgtgtgaaaacaagtacaactacctcacccagcaagcacactttctaaaagttaacccttaaaaatatgcattcccaggccaggcacagtggctcatgcctgtaatcccagcactttgggaggccgaggtaggcagatcacctgaggtggggaggtcgagaccagcctgaccaacatggagaaaccccgtctctactaaaaatacaaacttagcgggacatggtggcgcatgcctgtaatcctagatactcgggaggctgaggcaggagaatcacttggacccgggaggcagaggttgcagtgagccaagatcgtaccattgcactccagcctgggcaacaagagcgaaactccatctcaaaacaaacaaacaaacatgcattatcaggccaggcacggtggctcatgcctataatcccagcactttgggaggccaaggggggcagatcacctggggccaggagttccagaccagcctagctaacatggtgaaaccctgtctctactaaaaatacaaaaatgagctactaaggaggctgaggcagaagaattgcttgaacctgggaggcagaggttgcagtgagccaagattgtgtcactgcactccaacctgggcgatagagtgagactctgcctaaaaaaaaaaaaaaatatatatatatatacacatatatatgtgtatatacatgtatatacacatatatatgtgtatatatgtatatatgtatgtatatatatgtgtatatatatacatacatatatatatatatatatgcattatccctttctgccatcacgtgtccattggagacctcaaatactagctgccccaagcatttgaattcaaccaaatggaagcccaccagaaacaatggtagagcagccaaggaatatgagattgagagacttctgtcaaatgcctttgcagggttctctggcacgcaggcagagcaggggctaataaccgagaaaagcagagtggcacttggtgcagacacacagtgcaatataattcagccttcaaaagaagagaaatgttgacatgtggtacaacatggataaactttgaggacattatgtcaggtgaaataagccagacacaaaagaacagatactgtataagtctacttacatgaggtatgcaaagttgtccagttcatagatgagacagaaaggagaacagtggttatctgggaccagggggaaggagagatgaggagtcagtgtttaatgggtacaaagtttcagtttgggagatggaaaagttcaggagattggtaatacaccaatgtgaatagacttaacactgccaaacacttagaagtgactcagatgggccgggcatgtggatcacacctgtaatcccagcactttgggaggccaaggcaggtagatcacttgatgtcaggagttcgagatcggcctggccaacatggtgaaaacctgtctctattaaaaacacaaaaattagccgggcctggtggcgtgagcttgtaaccccagctactggggaggctgaggcaggagaattgcttgaacccaggaggcagagattgccatgagccaagactgcaccactgcactcttgcctgggtaacagagtgatattctgtctcaaaaaaaaaaaagaaagaaagaaagaaagaaaaagaaaaagaaatggctaagatggtaaattttacattgtgtgctttttatcacaatttttacaaggtttttaattgccagctctaagttctgcaaaggcagtgacaacatcttagacgtctgtagattccaggaaccttgcacagcgccagaaacatgtgagagttcacgtccagcttgcggaacactgaggatgaaaatgatgaaatgcattagtgcatagctgggcagatggacagagcagcccttcaagggaactgatgtttctcttcccgaaagtgttcagggggtgtggcagatgctcttggtgatctgcatcacatcccccggcccacctctggttcagccacagctgcgatggcccaggtcatacatgctgacaacatccacctcccacagcaagccaaggcagcaggaaaaaggaagaaaaagagtgaagcctcacagtaaagaggaggtgtctcaccggtattgggctacagagaaaagccaaagcctctgtgccacactcttgggttgaccgtgccacgctcttgggttgaccgagccacagccaacgtcaaaacaaacaagataacatggattttcatattggattaaaaatcaaaacacaaccaactatggggccaaatgattcatacctgaataatttctgtgtgaacaatgctggaaaccttcacataacaaccagattgtttcctggcaaaggtacagagatttcgcagaggccaaacagggtcctgcccttccagccgcagagcagagaccggacccagaccgggaccctggagctgggggtttcacagccagtcacagtgcagccctttaataggcagagttgcccgatttagcaaattacaatacagaatgcctggttacgtttgaatttcggataaacaatgaataatttcctagtgcaagcatgtcctaaatattgcacaggacatatcgtttctctgaattcaaatgaaactgggcatcttatatctcatctggcaaccctagctaagggggatttatccagattttctgtaaccagaattttctggaaccaaagttagttattacttttgtctcttaatccctgcttcataacaacataagtgctagacccaagatctggcaaaatttaccaacgtaagccaagaaagtgctgaaaacctgatagcactgtcataaccaacaattatttcccctcagttccttcaacaaacacctgctgagcacccattctatgccaggtgccacaccaagtgtctacgaagacaaccgaagtcttcacagcaaaggcagatcatgatgctcacagagcaaagaaaaacatcagaataatttcaaaaacggggtggtgggcaaggggagggaaagcattaggacaaaagctaatacatgcggggcttaaaacctagatgacgggttgatgggtgcagcaaaccaccatggcacatgtatacctatgtaacaaacctgcacgttctgcacatggatcccagaacttaaagtaaaagaaaaaaaagaaaataagaagataaagtaaaaaaaaaaaaaaaaaaaattaaacaggttcaattcaagcccttcttgggcatcaactgaaatgcaggacactgtgctagtctctggtcgaggggacttgaccttgcgggatgtgtggctggtcagtagcctgtcctcaaagacagctgcagtgtcagccaccaggtcttccaaataaaaggtcataaagctgtattttcagtggttctcttctttccaatgacgcttcctcagttcttaggattatttgaagattggcattttattggacacttacacaggagtgatatgattaaaaagcaagccataaattggttagtacccagtccttttatttgccttcccacacatgtgaagcacccacagagaacagccagagaacacagcaaactggcttccagggcatgtggaggaagggagattctaaccacctagaatgtaattttttcatttttaacaaaagtcaaggtgaatctcacagaacatgaaattaacctttttttttttttttttttttttttttttgagacagagtcttgctgctctgtctcccaggctggagtgcagtggtgcaatctcagctcaatgcaacctccgcctcccacattcaagcgattctcctgcctcagcctcccaagtagctgggattacaggcgcctgccaccaagcccagctcgtttttgtattttagtagagatggggtttcgccatgttggccaggccagtctcaaactcctggcctcaagttatccacccaccttggccttctaaagtgctgggattacagacctgagccaccatgcccagccaaaattaaccatttttaggtatacaaacaaatagcatttagtacatccacaatgttgtgcaaacactacctctattaagttccaaaacatcttcatcaccccaaggaaactctgtaaccatccagcagccactttccatttctccctcctcccagccccaggcaactaccaatctgctttctgtctctacggatttgtgtgttctggacatttcagctaaatggaatcatacacatgtgaccttttcagtctggcttctttcacttagcataatgttttcgagactccgtcacactgtagcatgtgtccgtgttgtggcctgtatccgtgctgcggcatgtgtctgtgttatagtgtgtatccatgttgtagcatgtatgtgcattgtggcatgtgtccatgtgataccatgtattcgtgttgtgacatgtgtccatgctgtagcatgtatctgtgttatcacatgcatccatgttatgggatgtgtccatgttgtaccatgtgtccatgttgtctgggttgtcacatgtgtccatgttgtagcgtgtgtccatgttgcagcgtgtgtccatgttgtagcgtgtgtccatgttgcagcgtgtgtccatgttgcagcgtgtgtccatgttgtagcgtgtgtccatgttatcatatgtatctgtgtttttgcatgtgtccatgttgtagcgtgtgtccctgttgtagcgtgtgtccctgttgtagcgtgtgtccgtgttgtagcgtgtgtccgtgttgtggcatgcatccatgttatcatatgtatctgtgttttcacatgtgtccatgttgtagcgtgtgtccgtgttgtagcatgtgtccgtgttgtggcatgcatccatgttatcatatgtatctgtgttttcacatgtgtccctgttgtagcgtgtgtccatgttgtagcgtgtgcccatgttgtagcgtgtatccatgttgtagtgtgtgtccatgttgtagagtgtgtccgtgttgtagcatgtgtccgtgttgtggcatgcatccatgttatcatatgtatctgtgttttcacatgtgtccctgttgtagcgtgtgtccctgttgtagcgtgtgcccatgttgtagcgtgtgtccatgttgtagcgtgtgtccatgttgtagcgtgtgtccctgttgtagcgtgtgtccatgttgtagcgtgtgcccatgttgtagcgtgtgcccatgttgtagcgtgtgtccctgttgtagcgtgtgtccatgttgtagcgtgtgtccatgttgtagagtgtgtccatgttgtagcgtgtgtccgtgttgtggcatgcatccatgttatcatatgtatctgtgttttcgcatgtgtccatgttgtagcgtgtgtccatgttgcagcgtgtgtccgtgttgcagcgtgtgtccgtgttgtggcatgcatccatgttatcatatgtatctgtgttttcgcatgtgtccatgttgtagcgtgtatccatgttgcagcgtgtgtctgtgttgtggcatgtatctgtgtttcattccttttcatgcctggataatattccattgtacgcatataccacattttgtttttccattcacctgttcaggagcatttttgttgtttccactttggggctactgtgaatactgctactgtagacatttctgaacaagtatttaagtacctgctttcagttattttgaatatatacccagaggatgtgctccatctttacatcaatgactctcaatcctgactatactctctagtaacctagaagggtttagaaagaattccagacaacccactctagacaagtcctaccctagacaagtgaatttgaatgtattgggggggctacggagctgtacttttgggtgtgatattctatacatgtatattaaaaacttaaacgtctataagtaatttaaaaattttagttatttgtaaagttaagaataatgctgactattttttctgccactcaacaggtgtagtcgtatgactttcatggtttactctttctagtccttgctttttaaaaaaagttttatggaagtttaatttacacaccataagatttactcattttaagtgtacaatttactatatacctagcataggtgctctgtaagtgtttgttgaaggaactgagggagaaataactgttggttatgacagtgatattaggttttcagcattttcttgacttacattggtaaattttgccagatcttgggtcttgctagatctcttaacttgctcgttttaactttttaaggaatcttcaaatattttcctgcttcattttacattcctaccagcaatgtacgagggtcctaatttttccacatcttccccaaggcttgtaactttcctttgtttgttccattatagccatcctagggtgtgagaagtggttttggtttgcattttcctaatgactaattgtgttgagcaccttttctgatgctttttggccattcatatgtcttctttggaaggacgtctgttcaagtcctttgctcgtattttaattgggttgtttatccttttgtggttgagttgtaaggattctttgtatattctggacactagactcctatcaaatatatgatttgcaaatattttctcctattctgtaggttgtctttttagaatgtatttttttaagagcataacctgatactctatctctttctttcgtgttcttaacggccaaacacttctcggtgatgaaccagatggcaggagaacatgaaaacagttacaaaggtctccccattcctagagttaagatttccttttaatgttaggttagcgcaaggtcttgtaagtccttcagttttgatagagatgaggaattgaggttacccaggaaccccaggtggcagcttggaaatggggtcaagcagcccaggaaaaaaaaaaaagagtttagaaaacaaagtggcgggaactacagcggaatattgctagaaaacaggacatcacagtctagaccccaaactttattgtccgttgcaatcacaaggggatcttcttaataaaaaatactgacacttagtttccatcggcagctatttgatttcattggcatgggtgaggcttaagcaatagatttataaaagctcccgtggattctaacgggcggcaaagtttgggaaccactgaggttggcaatggagccgtcaaaccacagggatgaaggctgacgctaagccagacttggagcctcttctctcaacgtggagttggggttggagcaggaggactgtgggaagggcaagtcccacaagtccaagaagccagagagggactcaagtacctttaagaagctcttttttgacaccaaatgtcctgaacaatcatgcttttctccaaaagaagatgagatacctaatttaacgagcttaagactgtattacgaagactgcaccggcccactgagcttggctattgggatttctccatctctggtctccatgtggaagagcagaagcaggagatgggaagaggttgtttccaccaaccacataattctacactggcctgtatctgagagtgaaaacttgtcggtggaaaagaggaacaaaatacattttaacaaggatctaaagtcagagtaatctgaagggccccatgaaattgagaaacaactttgtttaattttttttttttttttaaaccaaatctgactctgtcacccaggctggagtgcaatggcaaaatctcagctcgctgcagcctccgcctcccgggttcaagcaattctcctgcctcagcctcccaagtacctgggattacaggcatgggccaccacgcctagctaatttttgtatttttttttttttttttagtagaaatggggtttcaccatgttggccaggctggtcttgaactcctgacctcaagtgatccaccgaccttgcccttccaaaatactgggattacaggcatgaaccactgcacctggcccaatcttgtttaatttaaaatctgcttctgtaggtcaagattttgatatagttaatattcctaaggtctgctggaaaatccaagggaatagatctcaacctttactgagcatctgaattagctgcagtgcttttaaaaatatagctgtttgaagtctacagggatgaagagtggatcagcggttgcctggggctggggtagcaacaggatgtgactgcaaatgggtacagggatccttctgaggtggtagcagcgttctaaaattggaccctgatgatggttgtacaactctgccaatgtactaaaaatcattaaattatacacttcaaataagtaaatgctacagtgtgtaaattaaacttccctaaaacttttttaaaaagcaaggaatagaagggataaactatgaaaatcatacaaccacacctgtcaagtggcagaaaaaaataatcagcattattcttaactttacaaataactaaaaattttttaatcactcatagatttttaagtttttaatatacatgtatagaatatcacacccaaaagtacagctccgtagccccaccctaatacattcaaattcacttgtctaggctagggtaggacttgtctagagtacgttgtctggaattctttctaaacccttctaggttactagagagtatagtcaggattgagagtcattgatgtaaaatcacaaggataataaagtaagtaaggtattctttttctcacttgatgtttctcattttattttacccctagtcattggggatcttgtcataaatgaaaattttctgccaaaaaaagtattggaatcatggcaggggtagtaatttaggccataagtgagacagttggaagtttatgagtttagcaaagacagtagagtaaccagccttaaaacaatcacacagtgggaatatctgtctcggaataccaatgagaatataccttcagaaatcacacatcccaggcatgtttcaggaaagcgttcatttcaaatactctgttccactgagctcttaaagcatgagaatattgtagaggataagaactgcggaagtggagaacggagagacagtagagacagggagtcttgtatttcaccgtataccaatttgtaatgcttgagattttcaaccacgtacctgtgttaactattttaataaacagaaattataatgtttcatcttccaaaatacgtctcacaggattgccttttacactgggaaagatcccattaatttacaattcaacagatgtgggttcaatcctgatatatcataaagtaaactgaggcaaaggtggattgtattgctcttagcctttctttttatttttatatttaggaagagagttggaatttgaactccacccacagtaatgtacagtctatttaatgaggaggtagatagtgcagtggttaagggtataacttggaataaaatagacctatgtttaaattctatttctatccataattaaatatgagaccttgtccatattactgaacctctgttttagtaagtaaggtttctcagcttcttcataattaaaatggggattgaaaaaaaaaagctaagagggttgttataaaaattgcatgagataatacactctgcaagtgcttagtctagtatctagcacacagtagtaatcctcatctagaattgcatctttaaagatgaaaatgggtccgtggtggccgggcgcggtggctcacgcctgtaatcccagcactttgggaggccgaggcgggcggatcacgaggtcaggagatcgagaccatcctggctaacacagtgaaacctcgtctctactaaaaacacaaaaaattagccaggcgtggtggtgggcgcctgtaatcccagctgctcgggaggctgaggcaggagaatggcttgaatccggaaggcggagcttgcagtgagccgagatcgcgccactgcactccagcctgggcgacagagcaagactccgtctcaaaaaaaaaaaaaaaaaaaaaggaaagaaaagagaaagaaaacgggtccatggtgagagatttacttagacaaattccagaagttagatttcttaacacagccagatctatcagcggaatgtattggcttggacctcattcacacaatcatagttttggtgcaagcccaattccagtttgatctttagcctggatttcttctggaaaaacacagccctgtccagacaaaatcacaacatcctgtgcttcaagctgctaaggctgccattttgcaggaacaataaccgctgagctctgaaagacgggagtggggagcagcaaaaagggaatccgtccactgcacctggctctgggacatgcttgtaaaagcttcatgttctggacggcaaagtatctgctttggtacaaggagctaagaaaacaatttccttaaaaacaaacagatcccaagagatcaaccgtttggaaaaattcctctgagacactaacaggccccgaatataaacagtaagcaactttttttagctaacagtcataattcatactccctccaaacaaaacacatacacaccccacaacacgtacacatctctgaagagtcattatgattctgaaaattaggcaaaacacatttcattactgcaacaggactcccctctgaaccttctgctgacacagctactgaatgtgttctcatcccagacacacttcacagatactctaccctccttacgagatcctgacaactctgccccctgagaaaatacttctttcccacagttgcacatgagaaaattttcttccgaggtactgttagagagaaatgaaattttaaaacattcttagttatttgtgtttgcttttctttttatttatttatctatttttttcatagagacaagttcttactatgttgtccaggctggtctcaaactcctgatcttcccaccttggcctcccaaagtgctgggattacaggtgtgagccaccatccctggcctgcttttcttctgtagttcgaagacactcaattagctacctactgtttaacaggcattatgttaagtgctaaggagacacaggttaatcagaaacagacctgctttcgaaggcaccaatgatcttattacagaggtaagttttgcaacagaaaaaagtcaatataatgtgaaaactagtaataatttttaagctctcattctgcggccaaccctttacatacatgagcacttcacaatgacccatgagctagttattacccctgtttcccagatgtgcaagccaagtcttacagccttgcattttttacaaggttacaattaacaactgaactaaaatccattaaccatacagctaccacctgcatgacctaagaatggtgtattggatctcatgccatttctaaatgccaggtaccttgacaatatttttgctttttctagataccagctagatctggattaagaatgtcaagctcattgtttggagtcaacacataacaaaggacttgagtccaacacataacaaaggacctgggtctctcgcagagccaggaaacgctcagtctgtgagagtgaatggcctctcacatagtcattaactcaactgcatgctgggggagaaagtgtattttccgcactgtttgcccctccatagaccaccagctctaggccttggttatttttgcattatgttaaataccaacattctctgattccgcttgtccaggcaacgctctctctcttctcctgccgatcttatccctaaataccctggtccaagaagacttcctgggtcattctatgattgtgcagccgcaggcactgaatacagattctgcacatactctgctcatcatttaccatttctccactctcaatgtcacaattctctgaaatcttaaaattccagtcctggtgcaatttttgaacattcctgtctcatccaattcaacactgaccagccttactggtatattaagtatacagcccaacacaagtcaatatttaatatatactattagctgaaattcatatagtaactaaagtcactcttttagactttgtgaaaaccagaaagccccctcccaaaaaaagaaaaaaaatacggtgattaaaactagattatactgtagtttttcatttcaataaatgaagagctattttaaaaatcagaatttgagaaaatttaaaaatcagaataattctgctaatgaatcaagatgcctgtatcttacatctatactaagcatttttcattatttaaatttagaaagaatataacatattgctgaatgttaaaaaacagatttttagaaaatggccccacaatctcatacccctgatacaaaatgattattttctataactttctagtattttatcagcttcatatttaacattatagtacatatacaatttgccttttcttctctgccacatgctgaattgttttataatcgtaatttactaatctcttccatataattgaatctttaggctgatggaatgtctttgctaccacaaatattatcaaacgagcttgtgcatatgacattcccaatatgttagatgttctacctaggatagatttccagaagtggtattattgcatcaataactcatacatttttaatctcctgttacagcatgggctgtattttatttttaataaaaaaaaaatgggccgggtgcgctggctcacacctgtaatcccagcactttgggaggccgaggcgggtggatcacgaggtcaggagtttgagaccagcctgaccaacatggtgaaaccccgtctcgactaaaaatacaaaattagccgggtgtggtggcacatgcctgtaatcccagctactcaggaggctgaggcagcagaatcgcttgaacacgggaggcggaggttgcagtgagcggagatctcgccactgcactctagcctggcgacagaggacttcgtctcaaaaaaaaagaaaaaaagtaccagttgctgtcttagcttcattgctatcattccagttcctacaaaaatgcaaaggctttgctgaagggaagggtgccatctcttgcagatttctccgaagccaaggaccagctgggtgttttcaccacagatctgcacgaacccagcacgcaggactcaccttccccgcgcccactgcccctctgcctgctgttgtgaagcggcagcacctccagggatgcgatgcccgcgctctccaggatattcacgtccacgctcagcctcccggacagctgctggggccgcacgctgatgctgtgctcgtacttgcccaggcgcctctgcagaagctcctcataactcaggaaaaaggcggctttgtccttgctgggaatcactgcagaagctctgaatatttcagtccccttctctctgtcaggaaaaaggaaaaggaccccagggaggttcggaagaggatagagccaggttccctcagtccccacagggcaccagccataccctctcaaccagcctgccagggagacccatgggtgtgagtgtgggtcctgagaaaggaaaaataaaaattcgtattagaagaagtgaaaccccgtgctagaggtaggtcacgaagggtcaaagaataccgaccaggagaggattctaagaatactgtcctacctctccctgagacagacccaagggagcaatgggaaaggacgttgagtaggtgaactgctagaagagagagctttggagtgaagctgtgaattgtgctctccctttacaaggatggccaatgaatcttggcattttacataactttaaaatagctaacatactaggttttcacatcttggtaaagtttggtggatatgtttagcaggaaaggtagggaataaaggactccaaagctgacaaaaatacactccagatgctttcagtacttggagtgagggttctcttattcaaaatggcagactgatcactagaggaataagtgggagtggcaaccgttagtaggtaagacatttcaagaagtttccagaaggcttggggtgttcagtagagcaagaattttatagctcagaacatgcagcaaagggctgcagcaaaggagagaacccaactgtgtggcagaatcagagagagtgcaggctctgaattcaggacaccacaagatggaagggaaaagggagacccagtatagacaggataattccaagtccaatgtgaatgaatgactaagctgataggctttctatactcctccttcccagaactggaaagagacataagtattgaaatggaaaaattcaagcactgagcagaatgaatgaaaagagactgacaccgaaacccgccattgtaaaacttcagaacatcacacagagaaaacgtaaaagtgatgttatctggtcccattagatgtatcatcaatactactggatgttataagacattggagcaatgcctcaaagttcaaaaggaaaagtattttgaccttaaagtcatacacagccaaaatattaatcaaggtctcagaaagtttacttctcatgcacccattctgagaaagttacttcagaatataacttctgcaaaataaaggtgaaagccaagaaagaggaaaatgtggaatacacgaaataaaaaagccaacccagaagaatacgaaaagagataccagggtaaaagttttgcatcaaggctgaaaagcaatgaaagtatttcatggatataaagacatccatgttttaaaagctctgaaatcagaatgtctcccaatcagtgatgtctttcagctgctgttggccagatatcaggagtgataaggatgtcactgcttgcagaaacttgttcatagctgttcattttgttatgttaaatcataacatattttaaataatggttatgtgtctcgctagatgttatatcattttatatcataagaaaaaagaaaagcagttagaaactccaggaaaaacagaaacatatgtcatgattcaactaaactaatctgtagtgtgactctgaacaattgtgataaagaccacttgggataaatctatagtctaacagagttaggttttaataacttgccacagcaagggagaccacataccagaggcacgatgaggcaactcatcaaacaaagaaagagacagggtttttatagaattaggggaaggatggagtataggttaaatttaaatagagcagtgttcagacaggctcaaagcaaaggctgtgtgtaaaaccatcatttccgcctggactgacaagcagactaaagattctctatgtctttagaaactacgacattaagataaacgtggaattttgtgcctttgaaaatcccttatctgaagctctggaccttggttgcttttctgtatcaaagtgaacccatggctcatgtcctccagacaagagtgaggcattcccttgtcactaataaaatttccaacagcaaagtttctggcagtctataattttagagaactaaatttctcaaaatgatgtctttttattcatgaggaaaaccgggttaccaggttcacaccattttatctagatacaaagatcatttttctgccaaggggatgaaggcctacacattgggctggtgaagaggaaaaaataatcttagtgtactaggtggctctgcatgcagttcatgttatttctataggcattaaaaagcaattgctatgtattggtttcaatgtttagattccatttataaacaaaagaaagaataaaagtattacaagtcagaattaagatgctaataactcaaacaatgattaggtaacatcatgaaatgagaaaggagagagacagtggaggttaggagagggaatataatcatttaagatagtagggatagtccaagatagtctaaacactgttggattgatggaagaagaaataaaagaataatataaaaatgtgaatgcagagtaaaagtaggagtattgttaatttgctaaataccctttctttatagcaaagagtcaacagataatgtcttatttttatcaaaaaaaattttttgaagtatgactatcacaatatttagagttagggggtaactacaaaaaaaaaaaaaaaaaaaaaaactacgtacaggccaggcatagtggctcacacctgtaatcctgtaatcccagtactttgagaggctgaagtgcgaggactgcttgagccccgaagtttgagattagcctgggcaatgtagcaagacccgatctctacaaaaaaaataaaaataaaaattagctgggtgtggtggtgcacacctgtaatcccagctacttgggaggctgaggtggaaggatcacttgagcccaggaggttgaggctgcagtgagctatgattgcaccactgcactccagcctgggcaaagagtgagacctcattccaaaaaaaaaaaaaaaaggaaaactgcaaactacatatagaaatattagaagaggatatgtgtgggaagtgagcatgagagataaatatggtaaaattctcctttttattacaaacacttatctactatattattcactagatgtatttatattttgataaaaaagaaagagaaaagtatttggaggaaaggaagacgacaagaggagtaggcaaaggcatagaaaatgtggcactttgctaaaatgggtttttaattccttaattaaccaatacttacccattttcttctgtggttttattccttttctcttttaccctatcaccactcttcttttctctctctgtaatttcgccctgatacaccttgtctccaataagcctgaaatacaagagacagttgtgctaccagcttgcagttccaagacaaattcagacatggatcttataaccatgacaaccccaggaaatatttttatttgccttttggatgtgtagaaagaatgcattccagactagggcactacctttgaatcattcattttattctagggcaattttcaacaggtccaaatagcaagacccaacccatggtgcctctgtgattctccaggagaaaagtcacaagatctgctcacactaccatgaagattcaccaacttacatctgacctgggccaaaaattaaacccaacacctagcccgttttacatatctttacttcttggctcagagaaggaggaaagatatccaatctagtatatcaaaggttctacactgccttgtctttcaaccctcaacttcaccatggaggaggaagagcctcctgaaagctcttcccagatctccctaactgaagaagaccctcttggtctgacttgccatctttatcatatttgcaactgtctgaaattcatctcatttattctttgttcatttatctattgactggttctccctactggaatttgtgcagcactgtgaggctgtctttctcagagaagtgcaccagttttcatgaagagtaacctggcccataaaggtcattcatttgttgaaggggaggaaggaaagaaagaaagaggaaagaaagaaaggaagaaaaaaattgaataaaaaagagaaaatagaaggaagggagagagacgaggagggaaggaaagaaaaggaaggaaggaagggagggagggagggagggaggcagggaaggagggagggagggagggagggagggagagagggagggaaggagggagggaaaaagagaagaagaaaaggaatgaatgaatgaatgaaccaaccaatgaatttgaacaaaagaattgaccttctgatctatataccatctactggaatataaatcctcacagtcacaaggctgtggacctcacatctcaggctcaacctgaccaccctaggcagaaatcttcatccctgaccagcgtgtcacctacatagtgaagttggtgatgaaagctgcagctggaatctgcatctggaactcaatgtcctggtcttcagaagctctgttcagcattctgcaggaaaccgtagtgaaggcataacgggaaatgatggtagacttcactgagaattctgtcatcaaaggtttggttttctgtaggaatgaaaacacacagtatcatcggtgatgcatgaaagcattttggtggtagtggaacatctttttttttttccacaagggaaataatcttcagtttgggagcctttggcatgtgattccaatttcctttcttcttcttttcctgatttccccatttttaactcccttcctttgtaaaacaaccttggttgttttgcataaacaattaataacacacaagcaaatcttttaacctgactttaacaagtgaacacagtgaagacgtccaatttggcagaaaatacacgttccttaaacagttcaatcatcggaattttagaagtaaagtatgtgctgtatataatactcttctgttatcacttttatatcacatttacaggactaccgaaatgttccaaaaaccggaacatgactaacaaaaatctcgtattttaaaattactttcaatgtccacttagagaaacgatacaccagagcttccctatctgaattacaggcgcattactgtgaaataggaatcaatactgaactcagcagagtatctagagaatttagaacccagaaaaaggaacacataagtctgtgctaattaaatttctcccaaaagcccctgatgagagcagtaactagaagatgcaaatgtaaaagcctgttaaaactcttcagggctttttctagtccttacaacagagctacatctggtgacagctggtagcagaggcctgaagaaggaagaaaacatttgtaaggaaagccacaagccactgctaacagagtggttatctaactccaggaactggtcaagcaattaacaagcatgttatgggctgtgtcctcctagaatacacatgttgaagccctaacctactatgggaggtggtggggttgcggggaaggcagtatttggagatgagtgcctttgggagaaattgatttagatgaggtaatgaaggtggggtctctatgatgggattaatgcccttaagagaggagacataagagagctctctatctctctctccatgtgtgtgcaccaagaaagaccatgtgggcacacattgagaaggcagctgtctgcaagccaggacaagagccctcatcaaaacccaaaccctgcagaacctgggtcttggacttccagcctctagaactgtgagaaaataaatgtatgctgtttaagccacatggtctatagaattttgttatggaagcccgagcaagctaaaacaagacattaccccatgacagtctttgaagacatacgcagtaggtgttttattcccatttcatagatggagggaagtcaagcttagtgagggcacatattggtccatgccagcaagtaatggatgtggaacttgaacccgatcccacttacttcaaagtctgaactggccactattatgtgagactgtctggctgccctctgcagacacgtcctgctcataattgtgtgctcaacccccatgctggtcctgggcacacaaaggctctcaaaacatgttgaatgcaactggcttactctgataagattctactctctccttcaggaactgtcacctagctgggcaatgtttatttcagccctcatctgctttattaatttatttacagccctaggcctgttttcaaaacagatataaggttgcgacctattgctatcaaagacatattcctgctgtgacatacaaagatcatcacaaaccttgcttcaaaaaagttactacagagggttattctatttaaacaaatacgcactcaaaatgtttgcgtgaaatcacgatctgcatacaaaccaccaaaagcttgagagacattttctatgatgtattagagaggtggctacaaatatcaagtgcaccggctgggcgcggtggctcacacctgtagtcccagcactttgggaggccaaggtggacagatcacctgagttcaggagttcaagaccagtctggccaacatggtgaaaccccgtctttactagaaatacaattaactgcgtgtggtggtgcatgactgtagtcctggctactcaggtggctgaggcaggagaattgcttgaagcagggaggcaaatattgcagtgagccaagattgtgccactgcacttcagcctgggtgacagagcaagaccctgtcacagaaaaaaaatatatatatatatgtacatatatgtgcgtgtgtatatatatcatatatatcatacatatcacatatatatcatacatatcacatatatatcacatatatcacatatatatcatatatatcacatatatatcacatatatcacatatatcacatatatcacatatatcatatatatcacatatatcatatatatcacatatagatcatatatatcacatatagatcatatataatcacatatatatcataatcacatatatatgatatatatcacatatatatgatatatcacatatatatgatatatcacatatatatgatatatatcacatatatcacatatatatcatacatatcacatatatcacatatatatcacatatatcacatatatatcatatatatcacatatatatcatatatatcacatatatatcatatatatcacatatctatatcacatatatatcatatatatcacatatctatatcacatatatatcacatatatcacatatatatcatatatatcacatatatatcatatatatcatatatatcacatatatatcatatatatcacatatatatcacatatatatcacatatgtatcacatatatatcacatatatatatcacatatatatatcacatatatatatcacatatatatatcacatatatatatcacatatatatatatcacacatatatatatatatatcaagcacacctgaggatggacttgaacaccaagacagggagctgcaatggttggagccaagcacatgaggaaggggagagaatgggcaagcactccatgcaaaggtgtcagggccattcatctttgtagcagactgtgcaagaacttccagtcttggtaattcaaaaaagccagagacaaatggaacagcttaacgaaaacgttagggggatgtgcatctttcttagagagacagaagggataaacatttacagttcatttaagtaatgatcaagtttaaaaaaaaaatctgagtattgttgaaagagttttgcctaaaagaggaaaagaaaccttccagtttagtttgagaaggaattatttcaaagtagcgcttctcaaagtgtggtcctcggaccagcagcatcaccatcacctggaaacttgctagagattctcagactccatccaaatccacagaatcagaaactcagagggtggcccagcaagccgcagtttaacaaacccttcaggtcattctaatgcctgatcaagcttgagaatgtctctttttactaattgaactttaaaatatatatttcttcatctgcaagtgaaaagggcttgaataaatcaccaaaattacatccacatctgtgatccacagatttacggcaaagctaaaactgaggaataaaacctttgggtttaggaaattatgtctgaattgagaagctgtattatacagtaccatttaatggaaacctagtctcttcaggacaaaatctgtctctctcctccaaagcgattaggattaaaaaagagactccaacatgtagcttcaccaaatgtttctgttaaatgatctcattaaaaacatttcatacatttcagtaaaggcaatgaggattaggctggggatgataatgataatgatcttaacagcatgacaacctgtggggttttttttaaagttaaaatttgtatctcattatctttcaaaaaaagaaccccaaggtgaataagaccatgaattgagaggaagtgtttactttgatctgtgttatttctggaacaggttttctttctaaattatccatgattaaatatattcttttatctccaaatctaaactggtgtataagaaatgccccacggctgtgatcttgtgaatttgcgaagcatctagaataccactgcacccagctctgatttctacagatgcatgggaaagtaaataggaatcaatgctttaaaaaaaatcccacaaactcagtatattctagctttatcattctctgctttatttaaaatttaaactggtgttttaaaaattatcaagtaacatatgcacatggtaaaaacttctaattatgctgaatataaaatgaaaatagcagtctccctcccaccctggattcacagttccatttcccagagacaatgtttgacaacttttgtatatccttccataaatatatactgtactaatttgcttaatctcacctagtgatatagttagttcatctttctttatctgtgtcttagctatctcatgctgcttaacaaatcactctaaaactcagtggtttaaaacagcagcaatctttatgtttcctctcagggtttctgtgggtcatgaattccagaagggcttggctgggaggtctggcttctctacaaagggtggctgaagctggaattgtgagttgctgaggcagccaaggctggcatctctctatctcatgttgtccctcaatcccctctatatagtccttccaaatgggcaagtgtagatgaactcacagcatgggccactacacatgagtcagctggtcacctggtagccataggctttaccggtcacctggtagctttcccaacagcaaggtggaagctagatgccctgtcatgccctgacctcaaaaatcacaatgcattacttctatcatactctactggtcaaagcaggcacaaaggcacactcagtttcaaaggcagagggcacagacccccatctccatgggaggaatggcacattcaagtgctgccatctttggaaaatgcaatctgccactgaacaaaaaatatcaacctccttcctttttaaaaatagctgcatagtattacattttatggatgcattaaattttagttaaccagttctcccatcatccatcatccatttgtaatcatttttcatcatttttggaaagtcctttcagatgtccctgctctctcattcatctgtagcaggagtaggcaagctatgccaggcaggccacactgtttgtaaataaagttttattgaaacacagccacatccattcatttacatactgtctatggctgcttttctgctacaatggcaggaaaaacatggagaataattcagctgagcccagctgctcctgccaaggagcccggctcatgcaggaagctgcactgccccctccagagcagccatctgccaactgaacaccccagagcaacctccagcaacaccacaggccagaagaatcacccagctgagctctgtccaaatccttccccaccaaatgatgggataaaatcgttgttgctctaagccactgaattttgtggaaaatttttgtgcagcaatagaaaacgtgaacacctgtctagtctctgtagacattcgagtttgcaaccccacttcagtgtgactgctggtgagtgaaatttagttattttattagttatttccaactctatgtcatttctgatctttacacactttgttatgttttgtaaactaaactttcagcatattaaaaatatgcttgaaatttttttggaagaagttaaactatgaagataaactgtaaagaaaaagagcttcttaaatataaactcttcacttttccagtctaggccaaagtcattcactgtgtgactttgccagatcacacaggtaaaaggtagtcaaccccaatggccatccaaagcctcgatttccaatcctgtctctttcaaaaaagaacacagtggccgggcacagtggctcatgcctgtaatcccagcactttaggaggctgaagcaggtggatcacgaagtcaggagatcaagaccatcctggctaacacagtgaaaccctgtctctactaaaaaaaaaaaaaaatacaaaaaattagccgggcatggtggcgggcaccagctactcaggaggctgaggcaggagaatagcgtgaacctgggaagcagagcttccagtgagcggagatcacaccactgcactccagcctgggcgactgagcgagactctgtctcaaaaaaaaaaaaaagaacacagagacaccctggctaattcaagccttttcgcagtgattattgtttgataaccaataaaatatagaactccaaaggtatagtaaatataattcagtctttggtgctaattcaaaagttacttgtgaacctcagttatcatccattaaattgtacacattgaagatagaggacattaaactgaatgtattctctgaactgtagtcatattctgacacttcaaaaattcttcttgtcaatttatcatgtaattcttttacataaaagtagaatactagtgaggggagagtattaagttgacatcttagataagcagaagtttacagctgtagctgcacactgttccaagtaaaatttagctccttctgctaatagttcttgctcagtagtatttttaaaatagatcaaaatcttcttcacttagtatgcttgagaatatttttaatgtcatggtgatttgttcttatttatgagataagaaataatttcatttaatttaaaatgtgaaaactagaagatacctgacaatattaagtttatcacattatcttcttataccttaaattaagtgtatagatttagtagaattttccacaatattacatcaagaatatgaagcttagtttatgggcccaagagacaggctgaaaaaaggttcaagaaactattttagtttttgtgcttctgcccagctacaattctcccaggagcccctgctcttactgacataccacagcctggcccttctcttacagtttccttggtgcagaatctactagattcaattaggcacgagtctatccccctcccagttaccaacccttacccctgccctggtagattatgggattgtaaacacgaagaacagaagccatgactactacttactcctgttgtccttctccttccccttccccttcccttctcccttcttttcattctccttcttctcctctttcttctttcttcttccttctttcttcttcctcctttcttctttcttcccccttcttcttcttattctttcttcttccttcttcttctttcccttcccctcctcctcctccttcttctttgcattagaaagagtttctatttagatcatgagacataatagtgcttaacatgttgttctttttttacctacagctctcaagatagaggaaaactatatatatatatgaaatctaatcttttatgtctaaagagataggggatataggaatgggtaagtggatagatggatagatagatagatggatagatagataggtaggtagatagatagatagatagataccttgactataagaccttccagtgttgagaagaaagataaatcagtgaggtctgcaaaagtaagaaaatgttttaaaacagatgtagtatttacatgtggtgaaagagaacagaaagaacactctaagaacacggaagacatggaaatggaaatgaatcacagcacattcccagatcaatgactagaaaagagagcatgctgtgagaagaatattggacaggcaggtaacacaggaaacagacaaccctaaagaacaagcgaggcctttgaaaggcagaggctcatgaaaatgtgtcatgaaaggaaggatataaaacagtggcctcactttttcccagtgcacggttcttaaaaatccaacatgctttccatatttctatttaagtcataactttgttttgggatgtccgctggaaaatagtggtaaaaaaaatcttcctgtgacataagataatttcttcattattttttcctacaaaggcaacacagatggaaaagtcatttgaggcagggagtgtcttaattgctcaagggacccaagctttgggtatgactcatgtgaggcacttaaaatcaagccacccgaggatgtcctgagtcacccaagatgccatctggaaatgtggtggagaaatggttgggacggcctttgccagcactcaggccacagtgcctcttcctagaagattaacctttcattattttctttcagtctaaccagtctttagcaaccatgagaagtcattatggaggtgggagagaactttagaaatcatctaactctgctcccctttgttttagagagaaggctggagcgtggcagttggctgactccacgcaccaaatctctactaacccttaatgcttctcctttctgagaaaaacaatacagggccgggcgtggtggctcatgcctgtaatcccagcactttgggggtcaaagctggtggatcacctgagatcaggagtttgagaccagcctggccaacatggtgaaaccccgtctctattaaaaatgcaaaaaattagccaggtgtgatgatgggtgcccataatcccagctactcaggaggctaaggcaggagaatcacttgaacccgggaagaggaggttgcagtgagccaagataatgccattgcactccagcctgggtgacaagagcaaaactccatctcaaaaaaaaaaaaaaatacagcccatgttgttattgaatgaaacaggagaaaaaggcacttccccaactgctagatttaccacctcggggaaatcattttacccctctgtagacaggaaatggcatcggttctgaatcacctacttgtgctaatacagtctacgtagtgatgtttcattatatttaggggagaaggaaaacaaaatgccatttttatttttatacaagaaaaccctccccctcccccgccccattctatacacttcctgaacaggatgcacacaatggtcagagttgggcacaggcacagacacacatatgactggtcctcaatgaggtatgatgcccagagtcatgctacctgctgtattgactgtattttcttgttttctatattcttgatgctctggcatttggggctttgatcctggaaagaccgtccctcccagggctggcttgttcctaggaacagcagacaaccctgctgcaagcatacctttgatatataaaccgaccaatccatagccacacatccaaccatctcccatatcaaactcatgcacctcggctgggcacggtggctcacgcctgtaatcccagcactttgggagggcagggcaggcggatcacctgaggtcaggagtttaagaccagcctggccaacatggcgaaacccatctttactaaaaatacgaaaattagccgagcgcgatgatgcatgcctgtaatcccaggtactcgggaggcctctaatcccaggtgctcgggagactgaggcgcaagactcacttgaacccaggaagtggaggttgcagtgagccgagatcgcaccactgggctccagcctgggccacagagtgagactctgtctcaaaataataataataataataacaataataataaataaaactcatgcgccaagccaatactccccctaccctaaatctccccaggaccaggtacctgacaactagagaccaaccctacagccaatcctaaacctcctcagcctacctactaccctgccttgcccattccttcccatgaaaaccccaatgcaggctctgagacacacactgtcctctgcaccttctgcccctgacccaccatggtgcttccccatgtgtcctggcatggtatgctgctgcccctgcctccagggatctgtgagtatgaaattcctccttcatgtcagtcatttctctgtctgtgtatcttaccacactcaatagaaacaaaccctgagcacaaactgtagaacacctgctgcaaagcagacaccaagacagaccctgcagtcaggaggttaaatgatggcagcgaatcctcttgggaaacccaggccaggatccattcagcaccatggaaattcacacacaaagatccccctgctttccaaagagtaaatattttgtgtgtatgtatgccagggagcttcataaaaagggtatctaattaattcagaataaaatcaaacaaattcctgtggtcctggcagtgttacgggagtaccagctgttgccatccacattctattcattaattcaagcacggaacattcagaggatgacaactggagggagatggcaagaatgcaggctagaaggagactcataggatgaactgagctccagaggcaagcaggaggcgcatcacgcagggtttcacacatccttggagcttatcccacgggtgatgtggagtcactgaagacatgcacgcaagagagtgatgcgccaggtctaccactggaaaaatcattctagtaccaactggatggtcagtaaagttcatgttaaaaatttatgatagttgtaaaagtaagactttcaaaattctaagaaatttctaagaaaatctaagaggttatataaatggtctaagctaaggagtcaagaaaatctttgtacccttagaggctacgtgtacaaagcctctttttcctttcctttgaaaggaaaacataaactacttattacttaggaactgagcacttttatgtggcaaacataccagaaagaaagttaataaatgatagattcagagaggcattcttccagtttagaagacagaaggtatctatcacatacaaaggtctctgataaattgacaatgaggtggataaaaaacacaatagaaagatgggcaaaggacctggaaaaaaaaaagcaattcacaggagaacgactctgaatggctaacaaatataatttaaaatgtccaaatccttgttatggagaatggtttgagcaataaaagaaaaaaattccaaattcgtacataggcagggaaatgcaagttaaaggaacaatgagatatcacttcctaagtaagagattggcaaatttaaaagagtaattatatcagttgctggcagaaatgtgtgtattcatcattgctgatagacatggtatgaatacagatagtgttaagagtaatagtattcaaaaattaatctgacatctatcaaaaaaaaggttgtttttgagacagagtcttgctctgttgcccaagctagagtgcagtggtgcaatctcagctcactgcaacctatgcctcctgggttcaagcaatcctcccgcctcagcctcccgagtagctgggattacaggcatacaccaccacgcttggcaaatttttgtattttttagtagagatggggtttcaccatgttagccaggctggtcttgaactccagacctcaggtgattcacccccctcagcctcccaaactgctgagattacaggcgtgagccatcgagcctggcaaaatttaaaatgtatatgcagtttgaattgtaagtcgtagaattaaaaatacccacataaaagaagaaatgaaagtgttttttgaaggattgtgtacagggtgaaaaaatctggaaataaattgagagttcatcaataacagaaagtttagtaaattataatacatataaatacagatttaaatacatataactgagaggcccatttggtgtattagttaagagcatggactcagacactgaactggactcaaatcctggctctaccacctcttcccagctgtgtcgtcttgggaaaattactctctctgaatttgttttctcatctgtaaaatgcctcaaataattgttataagagtaattgagggccagatgcagtggctcacgcctgtaatcccaacactttgggaggccgaggtgggcggatcacctgaggtcaggagtttgagaccaacctagccaacatggtgaaaccccatctctactaaaaaaatagaaaaattagccaagtgtggtggtgcatgcctgtaatcccagctactcaggaggctgaggcaggaggatctcttcaacccaggaggcagaggttgcagtgagctgagatcacgccactgcactccagcctgagcaacaagagtgagactctgtaagcattcggttgacatgagccgtcacatgcacccatggttttagagcaatgatcagaggtctcccatatgcaaatgtgcctcgggttcccctgctgcattctatttttcagtggcacttgtcatcatctcaattatcagtatgcttacaatttacatgtatgtatgtattgctgggaggctattctccatgaatctctggtgtttctgcacaatttgcaagcagagactctagctgcctttgctgggaattacctttacaaacgtatagtgaacagcctcagaagacaggttcccccttcagggaagaagacagtttggcttaatgtgcagaataataaagaaaatatctccctccaggagcaaagaccaggcaggcttagtgctcattattaaagagtcgcgttccctaagttaagggctcctttcacacaatgcaaaccaactgcatggcaggtgtcatctggccatgtctatcaccttctgggaaccaggggaatggcacacatgctttgactactgctattactgtgagtaataaatcatcctttgtctctgacccaggagtctcctgttttctgctagtatccatgaaatggtaacaaactagcttattagcttgtaagtagctttaatctcagccccttcacagttcttgacatgtttaggtacatatgtcattgtctaggattatgtgaacatggagaaaacatgaaagaaggaatactaggcaaatgaatttggggtatggggaggtaagattgggaggatcagaagaaggaaaggagatgagaaaaccaagcaaaaaaaaaattttttttaattcaaaatctcaatccaaacaaagatagtcatgattgtgatattggtaatgacaagaaatctgaatccactcaaacaccagccaggtgcagggagggctaggataaatgcctcaccagagtctaaaggcatgtctctacattttgatatttcactccatgcacagtggtaaggaagaactgaggtagtttcaaataagctcttagagcttctgaacatttgccccggtcccaatctcttagcctccagcagcattgagagcctatccaactttcatcacgtgatgctttagtctacaaatgtcaattctttggttgctttagttgtttacttcacaacaaagctctcatttcctgagtaaggatgtcataaaaataaataaaagttatatttaggctttaaaaaaaataaacctgcaaagacctttgtgtttttagttctactgaaataatcaggtctccttccagaaaaaagaaaaaaaaaatccacttaaagaaagccttataaaagactcaactatgctgtttcatctcagaatttttctacaagcaactttatatgttttggaggatctgcaagcaaagtggatacctggttcaaaataaatagaagaatgagggaatggactttcaagatgcaccatgaatatacctaccagcctctgcaacagtctgacttgcctcgggaccctgagtccatcctagaaaagagaagagactgttaaaaaggtgatttttaaaagagaagagacatgaaatatgattgtgaggtcattctcacatgagttatacaagggggttaaaatctattcagattcaccaaaagctgtatctatcctgaaaagcagttttgactttttatcagggagtttgtttcgaggccagaattagaattcatccctgtcagatctggttgactcttaacccataatgtcacactatctcatcgcctgagcattcttctatctgtaagaggagatggatgaaatgacaagaacaaaaagatagagtatttgtattctgtttcattttatttggggcctcaagttaaactctttgctactgtgtctattacagtaagtaaaggtattcagtcttaattccagtgggctcactattcaacttaaaactccaggaaactctggaagcaaaactgaacttatcttgaattttcttcatggtgtcttttctggatgatttcttatatgcttccacatgccggggagggatgcgggaaagtgatgaaatcgtctttttttagacatggcctcgctgtgttgctcaggttggagggcagtggtgcgatcacagctcactgcagcctcaaactccctggctcaagccatcccccgacttcaacctcccaagcagctgggactacaggcatgagccgccagatcggggtcatttttgtattttttgtagagacagggtctcgctatgttgtccaggttgatctcatactcctgggttcaagcgaacttctcacctcagcctctcaaagtgctgagatttataggcgtgagccactgtgcccagccaaaagattttttttaaaaaaaactcattaataattaattaactagacactctggactaatttaaaggtcttagctgattatatggatgttactcatggcaaatctcattaactaatagaagtgtaaactattgttgctgggagtaataagttttccttcctttctggaaggcagttttacaatgtagatcaaaaacataagaaatatgcctagacttcatgtctatttttctttttttttttttttttgagacggtctcgctctgttgcccaggctggagtgctgtggcatggtcttggctcactgcaacctccgcctcccaggttcaagcgattctcctgcctcagcctctggagtagctgggattacaggtgcctgccactacgccccgctaatttttgtatttttagtagagatggagtttcaccatgttggccaggctggtctcgaactcctgacctcgtgattcacctgccttggcctcccaaagtgctgggattacaggcgtgagccaccgcgttcggccttttttttttttttttttttttagacggagtcttgttctgttgcccaggctggagtgcagtgacgccaccttggctcactgcaatctccaactcccgggttcaagcgattcccctgccttagcctcctgagtagctgggactacaggcatgcaccaccacgcccggctaattttacttttgtattttaatagagacggagtttcaccatgttggccagcatggtctggatctcctgacctcgtgatccgcccgcctctgcctcccaaagttctggaattacaggcatgagccaccgtgcctggccaagtttaactttttacgatactgccaaactgttttccaaagtggctgtaacattctgcattcccaccagtatgcaatcttttaatttataaattctacttacagaaaagggaagaaaatactgatagaaaaaaaaaatgaacacaaaagaaaattcttggaaacttttaaaacaattgctcataattagaaaaagcctaaaatgccctgaaaatgtggttcggttaagtagactatgatacattgattaattaccacacagctactgaaaataaggacctgcacctacatttactaacatgaatcaacattcattttactggacttcgaggttgttctccaaatatattcctagctctctgccagagggattagtccttgtgagtagacagggtcatgtgactagttctggccaataagttatgaatgtaagtaacattagtcccttctgagccaagcattaagttaatgttcagtgtcccagaactgccttttcttcagcacagtaattagtaatgtttggggtaatgactgctccatgaagcccaagttcacagtgaccaacaggtgcagagctgccccactgctgacccaagatggacaaggtgtataagcaagacataagagtttgttgtttaagacattgagaattggggattgccggataccacagcgtaacctagtctatcctgagagatatgttcatgacacaattttaagtgatgaaatcaggtaacaaaacactatatgtaacatgatcccatttttgtaagtgtaagtgtttttatgtatagaatgtgcatcaaagtgctaatcaatggctgttacctttgattgacatcttgttctttaaacttttctgtatgacctcaagtcttaacaaaatgcagatatttccattttgaagactaaaagtataagagaaactcttttaaccccattccctgctttatctccccacccaaaatatatatatacattgtaagttgccattctaagccattatagagtctactattcaatagaacatgggatggagaaaaatagtacaggatttaggctgacatccaccctgactccaagtaagaacctattgatgaaagagtcaaactctgtaaaatatttgaagagatttattctgatccaaatatcagtgaccatggcccatgacacagccctcagaagatccagagaatacgtgcccagggtgtcggggcacagctgcttggttttatacattttagggagacatgagatgtcaatcaaatacatgtaagacatacattggttcagtccagaaaggcaggacatctcgaaggtggtgggggcttccaggttatacgtagatgtaaaagttttctgattggcaactggttgaaagagttattatcaatagaaagaaatctctgggttataataagaggttgtggagaccaaaattttatcatgcagatgaagcccccaggtagcaggctttagagggcatcgactgtaaatgtttcctatcagacttaagatctgtgttgatgttcatgctggaggggtacaaggaggcatgtcaaacccccacttcccagacccccacttcccgtgacggtctgaaccagtctttcaggttaaacttagagggccctggactagaggaggaagtccattcagttggttggcgggccttcaaattttattcttggtttacaaaccaaacacttcctaggagtatatcggttttggaattctaaaatgaggtgaggctgggcacggtggctcatgcctgtaatcccagcactccgggaggctgtggtgagtggatcacctgaggtcaagagttcgaaaccaacctggccaacatggtgaaacctcatctctgttttaaaaagacaaaaattagctgggcgtcgtggcacacacctatattcccagctacttgggaggctgaggcaggagaatctcttgaacccgggaggtggaggttgcagtgggccgagatcatgccactatactccagcctgggcaacaatgtgagagtccatttcaaaaaaaaataaaaattaaaagtaaattaattaattaaataaaataaaatgaggtgagatgcacaagagactgtgaaaggaaggccatcatagggaccctgggcaagttctttatcagtcttgcatgatcatctcttgcccttccctccctaaattgtggagcagcctggggaccacttaaaataactatggtcagaaggaaagcccagcccctctcaggtattaagttccctgattgatctaaagtattttctttgaagttttctcttttgtaaaataggttttctgagaaaataagcatgcttcaaggagaacaagagaagctggtttttcatttttgagatgcctatctgatgtctcaggggatcactatggccacacttcagtccaagtttcaactcagcttgacccagaatcaaaacttcccagtacacgtacattgctggtgccagctaggattggaagtgcaaatgacattaataccatcatcgtttttagttaagaattcctgatcctttttattgtttgagtgttttcccggtgccttttaagaaacgaggggtggagtctggctacagaaaagtaactgactcccagcttcaggcaaaactaccataaatagccatcttagagcttccactgacttccttgaggccccaaatcatggacttaagagatggtgctacccagctgaggttatttctccagcatcagaacagaagatatccagaccacaacatttattgagaaaaacgtaagccaccatctctgccaccaaggaccatactctctaattttcaaaaatatatatgctcacgaaagcacaatagacaaagtgagttttataagttacaaaagaaatagatgaaagaagagatcactatgctcttgagtgaccgtgaaaggctttatgaagaagacagggctgcagcttagctgtggagatgtgtcttggagtgggatgaaagggaagaagaaagtgaaagagaatcaggttcaacacaggaacaatcctcagaaaatcaacttcatagacctgcacctgcctctaacacaaatggacccagcaacatcaccaccaggaaacagaaggtgaggtaaaggcttccttaggacgagcatgtgtcagtaacatcatcagagctgtggagtgtggaatctccaaacctaccccgttatcaattagtgcaactataggtgggaaaaaaaacctgccagtgccgcttaaatgtttataatttgactgataggggttgtgtttttcttcccaggatccaccggagcatcagatcatgactgagggaggaagagagataggtacttgagtcatctcgagagtccatccatgggaaagaatgggaggcaggaggagagaaacaaagcctaattcttgagcacagacactccacctttggtatggatgctgtaatgacccggttgacttaaagacagatgtaaaggcgaggtttgcatcctccattcttcttttgagctataacattgtatccgtgactctaggtcccataacacaggtgtctccatcgccggggcgtggacaggtacaggttggtggcccattaggaatcgggccacacagcaggtgagcagtgggcgagcccgcattaccggctgagctctgcctcctaatgctccaggcactagattctcataggaggcaaaccctattgtgaactgtgcatgcaagggatctaggttgtgttctccttacgagattcttactaatgcctggtgattttaggtggaacaatttcatcctaaaaccatccctcccacccccattccgtggaaaacttgtcttccacaaaaccagtccctggtgctagaaaggttggggactgctgccataacagatccaagagccattacaccaaggccagcttcagccaaacaccttcaactgactgaagtcatgcgttcctagagggatctgtacaaggaatttatctaccacctggccccattcttctaagggcattctgaaatgctgaaacccaaaccgagaaacttaagggccaattaccttagagatctgctataggacctggaacagaacaaagggctagatgttggaaagtcacatgagatgccatttatcatgtgggctgagaacggttagtctgagaatattcccatttgggtaattctatatcactcaccccaaatttttcttccttgaaagtaatgttgctgcaagtttgtttagctattaatcatttgcaatttgggatgcctatcaccttggtaatggaagaagaaacctgatattacagctaaaattccaaacaatttccagaaagattgttttttaagtttttttgaggcagagtctcaactcataccacccaggctggagtgcagtggcatgattacagctcactgcagccttgactacctgggctcaggtgatcctcccacctcagcctcccaagtacctgggactacaggtgcatgccaccatgcccagctaatttttgtacttttagtagacatggggtttcaaccatgttgtccaggctggtcttgaactcctgggctcaagctatctgcccacctcagcctcccaaactgctgggattacaggtgtgaaccactgtgcctggccgattaaaattttttaaaagcaactgccattaggcaagtcaccctgtttattttatttacctataaaatatcaggggtggggtgcggtggctcaagcctgtaatctcagcactttgggaggtcaaggcaggccgatcatctgagatcaggagttcgagaccagcctggccaacacggtaaagccccgtctctacaaaaatacaaaaattatccaagtgtggtggtgtgtgcctgtagtcccagctacttgggaggctgaggcaggagaattgcttgaatccgggaggcggaggttgcagtgagccaagatcatgccactgcgctccagcctgggcaacagagtgagactgtctcaaaaaaaaaaagagagagagacagacagagaaaagaaaagaaaaatcagggaactggatgtttcttgtgggaaaataatgagtggttcagaaccctcctcctaaaaaaagctcaggtcttcatcctctgtcccccatcttcctaaatcgacctactccactgctcctcagatccagaaacacccggctggcattcccagcagctacgctgatgacatgataagcaagatcgccttatatgtgagcatccaaggacttggggaaagtgctagttaggaacaccaagtcacacacagctcatcacccagttctcaggacttccccacccttcctttccaccctcaagaaatggcatatggctgctttgggagtgaccaaatccctggaatttctcccacagcatactccttccgcactctgccctacaaactcatttcaacaatccagccctgcacataagggagacgttattgaatggccagaagcttacaaaatctttcactggctttgttttttaaagagttgaaaaaaaatagctatcttgatttttgttgtttttttcccccccaaatgcaaaaatttgcttctcagtgagaatttgtaagaaattaaaaatctggaaatgtccaattcagggaattagaaatgtatcaccacaatagatgtttgaattatgactagcatatattgcacatcacctatgtgccatgagctacaaatacaaatcacatttaaataaattcaactaaattataaaagtgaacatggcttgctgtttgaaggatttgctgagagccccagctttggtgttcggcacacctacactccaatccaggctttgcacatagtaggttgttgcagctgtcacttctcagaaaggacttcctggttgtcctttgtcaaataagtacattgagacattacagcggtagtcagagacttaactaggctgtgcataaatagtaaaagcagctaatattacctaagtgtttactatatgcaaatgctttgcctgaattaactcatttaatcctcgaacaaccataaaagcagaactgttatttttataaaaattaaattattatttacatgctaataaaacataagctccaggacacctcacttgtgcaagcccctaaaaatgcgtgatgtttgtggtgcctgtcagattgtcaaaatgtgtaatttgttgtgctttctttatctttctaaataaatagtcattttagcacctaattttgtagttataatttgatacttttttccttcaagagggtcctgcaaattgtataaactttactctcctcccaaagcctagatccacccctgcctatgtagtaggaattattaacaactctatattgcagatgatgaaactgagacccagagaggttaagtgacttgcccaggtacacacaggcagtaagtgatggggtccagatatgagcccaggcagtccggcaccacatggagtactcaaccagaatacattattgcctcttattattttcacataaagctcctagcaaactccctgagacattgggacattacagatactcaataactggtggcttttactattttgtcaatctaaaactgctttgataataatgggaatataactctatctttaaagacaccatataaatttaagctaacaaaacagataagtctgtagcagacagtttttatacaagggattttcttttaaatactaatttcccaaaatatcctttaaaaatactactattcaaagtgtgcggctaggcacagtggcttatgcctgtaatcccagcactttgggaggccagggcaggtggatcacttgagctcaggagtttgagaccagcctggccaacgtgatgtatttttgtctctattaaaaatacaaaaattagccaggcatggtggagtgcacctgtaatcccatctgcttgggaggctgaggcatgagaatcacttgaacccaggagccagaggttgcagagagcagagagcctgccactgcactccagcctgggcgacacagcgagattccgtctcaaaaaaaaaaaaaaaactaaaatgtgttccatggaccacctgcatcagaatcatctgcgccccatcccaaacccaatggatctaaaccaatggaagtggaactcaggaagctgaatgtttaatgaacaccccaagtgactttttccaccccaagggtgaaaaccactgcttttaggagtcattccactatgggttactgagtacccactgtctacagatggggtgaagggtgagaggtgaaggaacttgaatctaaggtgttactggtatatttccaattacaggtgaatgacaaataactgcaatgcaagttaatagtcatattcagctatattaaaatttgcataagatttgcatagacttacatttttcaaattaagtttacatacaattttaaagaccataatgattgagaatagagtgctcattacattcccaggttctgttctaagatttaagtatattaattgtttcacttttcaaaatcctaagtaattgcatcatccccatacagagatagaggctcacaaacgttaagtaactcctcagtaagtgcagagccaagatttgaacccagaattctggtgctaaagcctatgctctcaaaccctatatcacaaaaactaaatataaaaaagaacggattagggataaaaggtaaaattgcaagttcatagaactttataccttggattttttttcctgatttagtcattttcaagataaataaatattgtgctgggttgaagacagcatgaaatcactaaaagaggtcaagccatgtttttttatgacagcaagtccatagactgtgaagcctacttgaacttggtatatgctagagtttaaacagccttcctagttcagacacagaatctttgtttcagtccatcccacactgtcctgtctccacacccccaaaaaagtttcaagatctttaccctaaattccttcactcagcatgtcagcagcatgagtctaagaccatggccagcattaagtgctgacagtgttttaagcacttgggtgtcataatgcattcagtcctcacaaccctatcatttctccacatttcacagaagaggaatataaggccgaaaggcacttgatcagggtcccagagctgataagtgacagaatcaagaatcaagtggtcccagacatcctggtaccaagcccatgccttcagccatctactaaaacatctcccagttattgagcgtccactgtataccaggtgcttaacacaaattagctgagtccttgcaagtttgctcaaaaagagccgcattccctgccctgaccaacgaggacatgaaggctctgagagattaaagggcttgcccggaacacacaactaaagcccagcctgtctctgcatccaaagcctgcacttttccaacatcactacgatgcctcctgggattttattagctactccccccctagaaggaagtatcattactaccactttactgttaagcacattcacaggacagagaacatgaagataactgtcttcatatttaggcagttgggcttcaaaactgctcttcaaaacaggggctggaaaagggagaaaaggtccgcctacttgtatcttcctcccaccgtgcacaaacacgctggaagctaaacggcttaaatatttaaatggcatgtgtgtgaaagcacttctactttgtgacagggccatgttgcacattagctctcaatgctatttgtgtgaacccgcttcatactttttaaagacaaaaatgctctattcatcattttattgacatttcatatttgcaggttttattcgcctgcgaggttaagacatttgaaacacaaatcctgacaaacgcacagaccagcaactcgaggaactcagacgctttggctctcggtgccacctttaaatgctaaaccaccggtaggtagtcgctaaatgggaaagtcgtgttctcccggttttcaggtgggaaaagctgaggctcccaggagtctagaactcctctcatattgcctttctccctggatcaactgggaatgatgataacagcagactgccccccacgcgtgataaggaaaaaaccttgtaattataataacttttggagctacctcagaaattaacaacgacgaacagaaatctgcgcaatcaacaggagccaagaagaaaaactcggctccgcaggacaagtcccgggcacagttctgcaggaagcctcaggccagatcaggcaccgcggctcacacagaggtgacgcacgagtgacccacagagagggacccctgggcctctggtgggggcctgggagacggtcgaagggggcccgggcagaagctccgcggccgggccggcggagggaagggggcggccgcgcccgggacccggctcccctcggctccacttacctgctccgaagagtggccccagctctgcgcctcttcctgcgaccccacacacagggacagccccaggcacagccccagcagcaggagcatggcggggcgagggcgcgggacgctcggggacccggcgggacacgctttgcagcgcccagggctccagccactgcgggacgctctcggggccgcccaccccgcggtcccagcccggaccccgcccaccccacggacccagcccggaccccgcccaccccgcggtcccagcccggaccccgcccaccccacggacccagcccggaccccgcccaccccacggacccagcccggaccccgcccaccctgcggtcccctcctggactccgcccaccccacggacccagcccggaccccgcccaccccacggacccagcccggaccccgcccaccccgcgtcccagcccggaccccgcccaccccacggacccagcccggaccccgcccaccctgcgtcccctcctggactccgcctaccccggtcccagcccggaccccttccaccccgcggtccccttctggactccaactctcccaccccagcccagaccccacttccccgccccagaccttcccacaccctgcctccctggacaccccccaagcccggcctcgcctccctgtccccagtcaggacccagcttccccaggtccccaaccccaagctccgtttctccacgcccccatttccccccacctccccagtcccggccccacctctcctgtccctgtccccaccgaggccaacttcccagaccccacctacagccacccccttaaacccggcccgcctccctgtggcccccacaccagccccgcctcctccccagtccccaccccgcccggcgccgcttcccggcctcagtcccaccagagccgcgcctccagcccccagtgctgggctagctctgttcggggagaaggcattccaagcctgcctcgccgcgcacagcaggggccacctgtgttggccccacggacccctcccacaccctcccatcctgcggctgtgacacttaaccaaggaccagtctcctctgtagagcctcctactccgtttcttgccaacacccactgcctcccgggccctaccccacgcgcccccgcaactctttcttcctctccctcaaggtgcaatatgcttctttgcggacttgcttaatttctgtcgccagaggacgcgagaaggccagcctggtcctcagcacacagcccaccccgcacctgccagcctgaagccggcagatcgtcccctctgcattggccagggacgcttaataggcaggacaaaggatactacctgcagtctagcgcaggagggactagcaaggctgccagcctttatgttctaaggaaacagaggagacgagggaagtatcttggtagcgtgtagtatttctgagtttctggttattaatcatgtaagtgagtgccagtatgtatcttagttacaaactattggtgatacttccatcctgccattggaagaattcttacccaccagccgtccacacctggccttctacaggctgagtgcgtcttttttatctggtgatacacattgcagttggggctacttgtttatttcatgttgcaaaggatgttttttatgtctctgtgataatttcatctaaataggtgaggtgagtgacagaccctttaaggaccaagaacagggaaggggctaacttcggaccatggaatagagaatactattccatgcaggttactatggggccattaaataatcgtgcgacgtctccagaaacatggagaatgttgacagtgtaatctaaagagaaaatcacatcaccaaatcgtatcaacagtatgattgcaattaggtagaaatacatatggagggacataactagaaaaaaaaaacatgaaaaataaaagcagtgggtaggttagtttgtggtgagatcctcgaaaatatctattcttgttgaaatgctctttgtttaatgaattaggagaggttaaaaacaaacaccttgctactgtgaaataaatgaaaggaaaattattgtcatcagcagttaatcctttaatagcctaaccactagtcagcatgcaaccaataagaaacaactgtagccggttatttttccctccagaggaaagtaactatttgtgaaccagaagttgaattggacaaagccagtttatttgcaatagggaaccatacagcggccattatttcaacccatgattgcaacagaacagagactccatcgtctttccttccctgccatccctaacttgaaatgctgaaagggcccatattaaactatttttgcctttatatctgatctctttttttttcccaaattcatactaactgggttttacagcagtctaatgttaagaaaagtgagttttattttcatctgggaggaccctctgattctaccctagactgtggttctaatgtgttgtttgtttaatataaagccagtttctccaactggatctgttctttgaggacaagcctctcccccaacttctagaactgtgctaaatatattgttagcacttaaggaccttttgatgaatgagattagtagatgggaggaatgagtgtggatggtagagccaggctgtgccagggaggtggggctgggctatagtgcaaacttgaccgctacctagctgtatgacttgacagagtttctgaacttcctattattttcaagctgtaatagttcagtattctatgtgacacctgtgtatctctatgatgatctttaaaatctaggtaggtgtgataaaaataagacctagtgaaagttttccaagactgtcaacaagcaaagacagtgatttatatcagccttataaataagggccaaggtgtccccacatacatttgtcctttgattccatgtttctcattttacctccaggaggagctgaatttccagttactgaacacataaaatctcaaagctagaaaagaccctgcacgatgtctagctcaattcattcaccaggaccatgtgccacgagtgacaaatcacagggaaggcccccggggttcacggacaggatctagaggcagagctcagcgacaagggactcagagtccaagaatgaacaggagctgtttctcctgggccagagatgctgctctgtccacgccacttctaggaaatcattccctcaagtaactgaatgatgggccaaagtattccagaattgtcgaatcacacttgtgagagttatccctttatcctggtctcctactggagactaccaatagatgggcccaaaatcatggtcaaaacaaccatgacttaacgagattaacgagttgaaagcaggctgcctgtttgttttcttttaaacctctcccttgattttacatcctgacaccccatagctcctaaatctagctatggttagagttaagccaccacccagttctttggtctccacctcctctccctctctcatcctcccttctgagcctctgtaaggccattgttctatttgggacagctctttctccccatccttggtctactccttttttatctacttatatggccttgtgtgtttctcttggccccctgacaactgtgtagaatcgctacaggtttttacaaccttggctttttttttttcttgattagaggggactactagggaggaaatgggttccttttgactttgacttgatgatttctcgggagcccagttatagcgtgtcaggagtctagttatacctacttttcatctgcttcaccaaacactgagttttgtccacagagatttgtgaaggaagaaatagggaatgcagttttctaatatatgattggtgattgctgaactcaactgttcacaaagtgtaacacttaccatattttaattattggcttgcagatttgagacctaaattagactctgatttcttcatggtcaaggattctatcattcttgttttgacatcctcaggctctgacacatggcctggaatagagtagacgtgctgtatgcttgatgaatgaatgaaaaaatgtatatctgccattatgttaccctgtgctagttgtgtgtaatatgacaagttttagacagactccgtgaccttgaagaagttaccatttagatatgaagatggagctaacaaaatggacaaaatttgaactcagtagtgatttcctaagaggagaagggacaagattgtgattgtatttgtggtctggaaggcttcatgaaggacgtggaaattaatatttgcatgaatttgattttgaaagccaagtggagaagagaaaacattaaggagacagaggaaggagggggaacaagggtggaaaaggctttgacagtggggaaagaacaatataaaattctgaggttcaagtctgggcagttgcctgtggaatttggtggggggggtgggggtgctgaaaactgggaaagtataacacagtgatccccaaacacaaatctgccaaccagtgcacattcctgaccccactttctccatctgcttctgaaaggagaaaactgagtcatcatggtgtatttcttttttttcttttttcttttttttttaactttgagacaagatctctgtctcccaggctggaacggagttgcgtgatctcagctcccttcaacctctgcttcacggggtcaagcaattctccctcctcagcctcaaccatgcctggctaatttttgtatttttagtagagatggggtttcaccatgtttcccaggctggtctcaaactcctgagctcgagtgatctgtgtgcctcagcctcccaaagtactgggattacatgtgtgagccactgtggcccgccaacttcttactttaaagaactgtcctttgctctgccttaaggcttttgttactccttgatcaataataatattgataacactgcctcactgtgagcccgtggggtggagagtgaaaagagtatgtccccaggggaggtatgtatgttggggaggggatggtatgtatgttggggaggggatggtaaaccaggatctcaggaaaacagtggaaaacctgcttaggtagtcatggtggctcgttcctctaatcctagctattcaggaggctgaggcaggatgatcacttgaggccaggagttcaaaaccagcctgagtaacataacaagacccccatcaggaaagaaaaaaaggaaggaagggagggagggaggaagggagggaggaagagagggagggagggaggaagggagggaggaagagagggagggagggaggaagggagggagagagggagggagggggaaggaaggggagaggaagagagggatggaaagagaaagaaagagagaaggagggagggaagaaaagaaaaatggaaggaagggagggaaggaaagaaagacagaaagagggaaggaaagcaggaaggagggaaggaagggagggagggaggggaggggggaagggagggaaagaaagacagagaaaaagggggaggaagataaagaaggaaggaaaagaaagcaggaaagaaagaaaagaataaccttcttgatgatacagaaatcctgctcacacatcccacaaacgtagtagcacatgcaacttataacaacgactactatttctgtttcccatgctggttgccactaccaatactataaagtgagtagttgaacacgagtacttttccaatgacatcagtgctgttggctccctacccagtattcatccaggctgtgacacctgtccagagtcatatatgtcaagagctctatacaattgtgtgatatgcctaatatgaaaagccaaaggaacgcaagcctctggcagtgatctcatcaaatctgctcatgcatctactgtgtgattcaccaaacccactttggagaatttatcatatgaacgaacctgctcatgtacagaaaggtgcaggtacaagattacgcattacagcatgactttgtttgtaatgtgcacattggaaacaacccataagtttattaacaggagtctggtcaggtacaatgtggtactatgaagtctgattagatacaacgtggtacaatgaaacctgattagatataacgtggtactacgaagtctgattagatacgacgcggtacaacgaagcctgattagatacagtgcggtactacgaagcctgattagacacaacgcggtactacgaagcctgattagacacaacgcggtactacgaagcctgcttagacacaatgcggtactacgaagcctgattagatacaatgtggtatctatgaaggctgattagatacaatgtggtactatgaagctgtacaaaagaatgaggaaggcttctatgtcttgctatagaaaaacagccagtatcatgtaattagggaagaaagagcaaagtgcaggctgactttagtgtaagaaagaaagaaaataagaaagcatatttatatttgcttgcaagttttgccataaagaaattctaggaaacataaaccatgaagaaaagtatttgcagggacggggtggtaagaggatgggaacacgacagatttgatctcaggaagggatgggttttgttttgttactgtattacatatttactgtattattttagtatttgattctttattgttgaccacagtgaatgtactacgtattcagggttaataaattaatttaaaactacagccaaaagaagaggaggaggaggaggaggaggaggaggaggaggagaagaatagctgacccctcaggtctctcttattgaagactttatctctcctgggtttgctgggtagatacaaaactcagtggctcacagtgggaagaaactgcactcccctcttctagcttcccctcctgggctcatgcgcatgcacacacacacacacacacacacacacacacacacacacgccagccatgctcaactccttctggtttcttcagcacccccattccttcttgccccttgctttgcatggattcttctcttttctggaatgtctgcctctacctccccaccccaccctgcaaatgtcacctcctccagggtgtctcgcaaatctcatcaggttgataaatgtcactcctgcctccaatagagcacccagctctttgtctatgtgtctctttctcactaaaccaagacccagtggagggctctgtcgttgtcttctgctttcttcctcttcctcttcctcttcctcttctttttgatggagtctcgctctgtctcccaggctggagggcagtggcatgatctcagctcactgcaacctctgcttcccgggttcaagtgattctcctgcctcagcctcctgagtaggtgggactacaggcgcgtgccaccacccccagctattttttgcatttttagtagagagggagtttcactatgttagccaggatggtctcgatttactgacctcgtgatctgcccacctcagcacctcagcctcccaaagtgctgggattacaggcgtgagccaccgtgcccggcaatcttcttttcatctttgtgtgctttgtccacatttagcatgcacctgagcttgggaaatgtttgttgaatgaataaaggaaacttggttagtatggtagacctagacttagtttacttagtacactttcatgttgtcatttcctttgaaatacctgtagcatcagtctgcaaaggcattgactggatgcaagacattagaccaagtgtgtacctcgctaaaggggagtatttttaaagagcagcagaatatcgactcctccattgccaaaaacatgttgggacacaatcatctctcttttttatttattcattttgtgggaattataattacaaaaactggaaaaaagcaactgaattttacgcacttgatgtaatactatattgatgcttaatcttttcttagagtgctgaattcccacgttcttgaattctttgtggcaaaagaagcaagttcgaatccatgcatttccccttcctcatctctatttctctatctcaaaacctcgcctcttcaaggatctccccgttttgaaaactctgctctcaaaaactggtacaaccatcctccagacacactaaaaataattttcccttgaaaaattttaaggttcataatatgtagcaatacatttattatattcctgaagtcatcagaaggcacaattagcattaattttgccttatttcctaaaagtgcatctcccccccgcccccccccccacacacaaagccaacacttgccttcatctttgctgttctgaattaatgtataatttagtgccaggcaaacagttctgaagaaatatttatcagatgagtgaagatttatttctacagaaatacttaaatagtgaaaaaaaaaaaatcttagtccaaactcaaggatcctttttattttctttggggaagatgccagagcaacaagttgcatcctagttttctaggctttaacctgggatcacagaagaccagggatagaacagaggatgtgctaacactatggaatatgatgcagcttcagttccacctgtctccacatcccatgctagtcccccaccctcgtgcttttttttttttttttttttgagacgaagtctcactctgtcacccaggctggagtgcagtggcccgatctcggctcatgcaagctctgcctctcggggtcacgccattctcccacctcagcctcccaagtagctaggactacaggtgcccgctaccatgcccggctaattttttgtatttttagtagagatggggtttcaccatgttagccaggatggtctcgatctcctgaccttgtgatccgccctccttggccttccaaagtgctgggattacaggtgtgagccactgtgccggacccgtgctttcttttactctatggcatgaagacagagaagccagaaaaacataaagctaatccccagggtgtgttttctccctgaagagttgccagatgtgtttcagacagatgttggggaatgtccagagagttttcgccaaaagctgcaggcatgtctttggaagggttttggctaacgtcaggcagtgctggtcttgtggttgatgctgagagataccaaatcctaacaatgaggcatcatcgggttctttaggtggtgccgaagggcaggttgcccggctggcggggaggaaagcttcttctcgctgcaatacatgtggcaggtttgcttcacccaggaacaaacatactgaacaaaatacgtaatccattttcccctacatgtcagagttatctccatactgagttcccattcccttgagcagaacaaaatttactcttgccaatgtacaataaaccatcaatatgggttttctcaaaaatcaaagtgttgctttcttaatcaattcagggttccttgccttcccacctatccatggagttggttctaagttccatgaagtcatcagggaatagggtgggggtgagggaggagccactggtcttgccatcacctgtgttatggactgaatgtttgtgtcccccccaaattcctatgttgaagctctaacccccactgcaatggtgttaggaggtgacaccctgtggaggtgattaggcttagatgaggtcaggaggatggagacctcatgataggatgagcatcctattaagaagaagaagagagaaccaaagagctcgttctctctctcactctctctcctctcttgtctgcacactttctctgtcattctcactctctctgtctctgtctctctttgttccctcccccattcccccaccactgagagaaggttgccatctgccagcctggaagagagccctcaccaggaacaaaattagctggggccttgatcttggacttccagcctccaaaactgtgagacataaatgtctattatttaagccactggcctgtggtgttttgttatagaaggctgagctgaccaataaaatctgtccaggctggtctgtgcaccatcacatctggtttagaaccatgtctgtctgcctctgtgctggactccacacagtggcacaactggccaccagttataaggattatccctctccacccaagtccccttctcccacctgcaagacctctccaggattgctgattttccacatcacatcccacctcctcggtcacctaggggaacctgggctccttccttctccatcaggagtgagtccatagacatgacaccaaaagcacaatctatagaagaaaacaatcaatcaattggacttcaccaaaatctaaaacttttgcttataaaagtccctgctaagaggatgaaaacataagctacaaaccagaagaaaatatttgccaaccgtgtacctaacaagagacttctatctagaaactataaagaaccctctaggccgggcgtagtggctcacacctgtaatcccagcatcttgggaggccgaggtgggcggatcacctcaggtcaggagttcgagaccagcctggccaacatggtgaaaccctgtctctacttaaaaaaaaaaaaaaaaattagccaggcatggtggcgtgcacctgtaaccccagctacttgggaggctgaggcaggagaatcacttgaaatcgggaggtggaggttgcagtgagctgagttcatgccattgcactccagcctgggcaaaaagagtgaaactccatctcaaaaaaaaaaaatctctaaattcaactgtaaataaacaatctgattagtaaataggcaacagacatgaacagatatttcaccagaggggataggcagatggcaaataaggacttgaaaatatggtgaatcttattagctgttagggaaatgcaaattcaaaccacaatgaaaaatatcactacccacctgttagaaccactaaaataaaaagcagtgacaatagcaaaagctggcagctttttgtaaaaagctgaatctctcagaattgagggtggaaatgtaaaatggcacagctattttggaaaatagtttggcagtttctttaagagaaaaaaatcctaaaaattaaacatatgcttactatatgacccaggtatcccagtcgtaggcatttatcccagtactaggcatttatcccagagaaataaaaacatgtctacataaaaacttgcatgtaatttttttttctgaaacagagtcttgctctgttgcccaggctggagtgcagtggtgcaatcacagctcactgcaggcttgacctccaaggttcaagtaatcctgcctcagcctcccaagttgctgggaccacaatcacaagtcaccacgcccggctaacttttttgttacttgtagagatgaggtctccctctgttgcccaggctggtctcaaacccctggactcaaacaatcctcctcccttggcctcccaaagtactggattacaggtgtgagacaacgcacctctcctgttcataaatatttataggagctttatttgtaatagcctcaaatttgaaacaactgaaatgttcttcagtaggtaaatggttaaacaaactgtagtacattgaacacatggactactacacagcattaaaaaagaaaaaaacatcaatgtgtgcagcaacctgaatgcatctcaagggcattatgctgagtgaaaaagccaatccgcctggcatggtggctcatgcctgtaatcctagcactttgggaggccgaggtgggtggatcatgaagtcaggagttcgagaccagattggccaagagatcagcctggctaatatggtgaaaccccatctctactaaaaacataaaaaattagccaggcatggtggcaggtgcctgtaatcccagctactcaggaggctgaggcaggagaattgcttgaacccaggaggcaggggttgcagtgagccaaagattgaaccattgcactcaagcctgggcagcagagcaagactccaacgcaaaaaaaaaaaaaaagaaaaagaaaaagaaaaaaaaaaaaagccagtcccagaaggttatctactgcaggattccatttgtataccattctcgaaatgacaaaattatagaaataagagtagtgttagccagagagggggaagggagggagggttggcgaagctatcaaagggaatttgcatgaaggagatcgctgagatgatgaaatgttgcttgactgtggtgttggatacacaaaattacacatgtgataagatgacatagaactacacctccctccgcgcgcgcgcgcacacacacacacacacacacacacacacacacacacgcaggagagcaccagaggctgctgaagcctgagtaagtttgcggattgtacaatgccaatctctctgattttcatattgtgctatagttgtgcaagatgttaccggggaaactgagtaaatggtagagggaacctctatggactactcttgccacttcctatgtatctagaatcatctcaaaataaaatttttaaaaagtaaagtttttcatatctacatctttgtggaagatgggagtctatgtggaggtggggcagggaggggacagaaaggtctttacctgctgtgcctgatatttttggcagccatgtgtgttgtccaaaggccatccgtctgctggagaatttcctcttgctctggggagttcagtctttgtctgattcaggacttcaactgatgggatgaggcccacccacattatgaaggaaaatctgctttcctcaaatctcatttcaatgtaaatcacacccaaaaaccagcctcacagaaacagaatactgtttgaccaaatatctgggtactgtggcccagtcaagttgacccataaaattaactatctcacccccagtgctgggttgtgtctgttctttcccagtcctcaccttcctctctttctcaacagaacatgtctggtgtattagtccattctcacactgctataaagatatacctgagactgggtaatttataaagaaaagagatttaattggctcacagtctcagcctgtacaggaagcatggtgctaacatctgcttggcttctaaggagcctccaggaaacttaaaaccatggcggcaggcaaagggggagcaggtgcgtcacatggccagagcaggagctaggacagtaccaaggggatgggactaaaccattcatgagaaatccacccccatgatccaatcacctcccacaaggccctacctccaacactgaggattacatttcaacatgagatttgggtggggaaacaaatcgaaaacatatcacctggtaaaagggaggaggactcggagtgaggagaccaaaaagaagagacccacccacccccactgagggctcccagcctaatgctggtcagtgtataagccaaggactctgggaaccacaatgcttcttctgaattctgtgttaaatttctccattctcagtagagctggtggctgcactgcattgtgaaggtattaaatgccactgaatcattcactttaaaatgagtaacttgttgcctgggcgctgtgactcatgcctgtaatcccagcactttgggaggccaaggcaggcagatcacctgaggtcaggagttcgaggccaacctggacaacatatagtgaaaccccgtctctactttaaaaaaaaaaaaaaattagctgggcgtggtggcaggcacctgtaatcccagctattctggaggcgaggcaggagaatcatttgaacctgggaagcagaagttgcagtgagctgagatagtgccactgcatcccagcctgggtgacagcaagacctgtctcaaaaaaaaaaaaatcatacttttaaaataaaaaatgaaaataaataaaatggctaacttgatgttatataaattttgcctcaatgtttaaaaagtatttttaaaaacaaaagaaaaacccatctctcatacttcaatagtgctaatacagtgaactgacacagtaattcggaatttaaaatttgcaacaattgcaagtaggctgggatggagatatagagaaaaatggaaaataatagaatagtgtgttttctgagacaatctgatggttgagctccacagtggcagcccgtctaataggggcttgcagcagcaaataatgagcttcaatggcatgaacattctttaaatgaggacagttcttttgtggaatgaaatcttcaaagcagttcaagattttttaatttattgaagatatttgtccctgcaattcccagatgcaaatgtgttattctactaaaatatcttaaatgtcttgttgatgatgttaattcctaagatgtagagaaaccctaaaagaggtctacatggctgcatccagggactttaattgaaattaaatgcgtacatcaattaagtccacaatgcacaataaaggcagcgagagtttgcatgctaatgatagcaaacacttctattttgcttacgtctgcaaggcatcattctaagtgctttactaacattaactcatttaatcctctcaacaaccgtacaaggtagaggctgtgattatcctgactttacagatcagcagagacaatgagaggttaagaacttgcccaacctcacatggctaataagtggcagactaaggtaggcttactttgtttttcttcttcttcccaaaatactatttaagccctacgaatttaagcctatgtgtgcgtgtgtgtgtacatccatgcatttgtttaatgtcaggtttcagaatttgtgacatgacacaatctttttcaatgtggccgtgttccaaaaataaaaaagatcccagtgggcgtgttggctcatgcctgtaattccagtgctttgggaggatcacttgagcccaggagttcaagaccagcctgggcaacaaaatgaggccctatctatacaaaaaaaaattagcttaacacggtggtgcatgtctgtagtcctagttatttgggaggctgaggtgagaggatttcctgagcacaggagactgaggttgcagtgagccaaggtcttgccactgaactccagcctgggcaacagagaaagaaaagaaagaaaagaaagaaaagaaagaaagaaagaaagaaagaaagaaagaaagaaagaaagaaagaaagaaaggaaggaaggaaggaaggaaggaagaaaagaaggtaggaaggaaggtaggaaggaagaaaagaaagaaagaaagaaaggaagaaagaaagaaagaaagaaagaaagaaataaagaaagaaagaaagagggagggagggagggaaagaaagaaagaaagagagaggaaagaaagaaagagaggaaagaaaggaaaagaaagaaagaaagaaagagagagaagaaggaaggaagggaaagaaaagaaaagaaggaaggaaagaaagaaagaaattaagaaaggaaggaaggaaagaaagagagacagaaagaaagaaagaaagacagaagggagggagggagggaagaaggaaggaaggaaggaaggaaggaaggaagtaaggaaggaaggaaggaaggaaggaaggaaggaaggaaggaaggaaggaaggaatccccagggactattatgaatatctccatgcacacaaactggaaatttttgaagaaattgataaattcctggaaacacacaaccttccaaaactggatcaggaattgaaaccctgaacagaccaagatcaagctcccaaattgaatctgtagtaagaaacctaccaacaaaaaggagccctgaacctgatggactcacagctgaattctgccagacatagaagaattctacaaagagctggtacctattcttattctactgaaactattttaaaacacattctacatagccagcatcattctcataccaaaatctggcaaagacacacacaaaaaagaaaactataggcagatatccctgatgaacatagattcaaaaatcctccacaaaatgctagtgaaccaaatccaacagcacatcaaaaagttaattcaccacgatcaagtatggtttattcctggaatgcagggttggttcaacatgtggaaattaataaatgtcattcaccatacaaaaaaaattaaaaacaaaaaccatatgattatctgtatagatgcagaaaaagctttcaataaaatccagcatctcctcatgattaaaagccctcaacaacctaggcattgaaggaacatacctcaataataagagccatctatgacaaacccacaaccaacatcatgctgcatgggtaaaacctggaaacattccccttgagaacttgaacaacacaaggatacccactctcaccactcctattcaacatagtactggacgtcctagccagagcaataaggcaagagaaataaattaaagacatcaaaataggaaaagaagtcaaatgatttttctttgccgatgatacaattctatacctagaaaatgctcacaactccaccaaaaggctcctagaactgataagcaacttcagtaaagttgcaggatacaaaatcagtgtacaaaaatcagtagcacttctatacaccaatactccagctgacagccaaagcaagaacacgtcccatttacagtagccacacacacacacacacaaacacacacacaaaatacctaggaatacatttaatcaaggaggtgaaagatgtctacaaggagaactacaaaacactgctgaaagaaatcgtagatgatattaaaaaatggaaaaccattccatgctcatggattggaagaatcaatatcattaaaatgccatactgcccaaagcaagatagagtcaacactattcctaagaaactaccaagatcatttctcactgaaatagaaaaaagtattctaaaattcatatggaaccaaaaaagagtctaaatagccaaggccaccctaagcaaaacaaagctggaggcatcacattacccaacttcaaactatactacagggctacagtaaccaaacagcacagtgctggtataaaaatagacaaatagaccagtggaacagaatagggaacacagagataaagctatgcacctacaactgcctgatctttgacagagctgacaaaaacaagcaatgaggaaaaaaactccctatttaacaaatggtaatgagataactggctagtcacatgcagaagattgaaactggacccttacctttcaccatacacaaaaattaactctagatgaattaaagacttaaatgtatgaccacaaattattaaaatcccagaagaaaacctagggaatattattctggacatcagcgttgtcaaacaatttatgactaagtcctcagaagcaattcagtgaaaacaaaaaatgacattgggacctagttaaactaaagagcttccacacagcaaaataaacgatcaacagagtaaacaggctatcaacagagtgaacagacaagctacagaacgagagggaatattcacaaactgtgcatctgacaaagggctaatatctggaatctataaggaacaattaaacaagcaaaaatcaaataaccccatttaaaagtgggaaaaggacatgaacaaatacttctcagaagaagatatacaagcagccaacaaacatgaaaaacaggctcaacatcactgatctttagagagacgcaaattaaaaccacaatgagataccgcctcacaccagtcagaatgacttttgataaaaagtccaaaaattacagatgttggtgaggttgtggagaaaagggaacacgtatacactattggcagaaatgtaaattagttcagccactgtggaaagcattttggagatttctcaaagagctttaaatagaacctccattcagcccagcaatcccattactaggtatatatccaaaataaatcgttctaccaaaaagacatatgcacttgtatgtttatcaaagtgttattcagagaagcaaagacagaatcaacctaggtacccatcagtggtggattggataaagaaaatgtggtacatacaccccatggaatactacacagccataaaaaagaaagaaatcatgttctttgcagcaacgtggatagagctggaggccattatcctaagcaaactaacacaggaacagaaaaccaaatatcacatgttctcacttataagtgggagctaaacattgaggacacaatagacatgggggactactagaggcaggagggaaggaggggaactaggacccaaaactacctatgctcagtaccttggtgatgggatcactcaaacaccaaacgtcagcatcacacaatatatccaggtaacaaacctgcacatgtacccactgaagctaaaataaaagttgaaattaaaaaataaaacaatgcatctctgtccctaataatgcatatgccaattctgtctaaatggagccatacaatttaaattcctaataaagtccattaaatcttcctgcccttctctagctcccctctgttcctcagtttatgctccctcactcttaaaactcccccctggccaggcatggaggctcacacctgtaatcccagcactttgggaggccaaggcgggtggatcacctgaggtcaggagttcgagaccaccctggccaacatggtgaaaccccaactctactaaaaatataaaaattagctgggcatggtggcacacacctgtaatcccagctactcaggaggctcaggcggaggttgcagtgagccgagatccctccaccacactccagcctgggtgacagagcgagactccatctaaaacaaaacaaaacaaaacaaaaaacttccctcccatccaatcttggcttcttgctgcttttcagccatctcttttgctttgtgcactgccaaagtctaaaactaaagcttttaacaaaaagctatcacaatgacctcctaactagtttctcttctgatttttctcctctctaatctttttacgatatcactaggattgtcttcttgctcttaaaaacaaatcaaaaaccacttgaaataggtaatattaaggaaatatgattcattatgtaagctgtaataatggtgttgtggttacataaaaagatattctcagttgaggctacatcttgagtgtttataagtgcaatgattcaatatctggaatttactttaacatacttcaggaaaagctgggcacccaggctcacacatatagacccaggtcctagagaggtggaggcaggaggactgcttgaggccaggagttggagaccagcctggacaacatagcaagaccctgtctcaacagcaacaaaaatttagccaggtgtggtgatgtgcacctgtagtcccagctactcaggaggctgaggcaggaggatcactggagcccaggaatttgaggctgcagtgagctatgatcatgccactacactccagtctaggtgacacagcaagatcccgtctctaaaacaattaatgattaaaaattttaaaaattaaaaataatccaggaaataaaaagtaggaggaataaatgaaaaaaaaagttttcaaatgtttaagatgattgaagtggtcattatggagacatactttcagtcatatcttcccatgagtctccacacttcagtcattccagccttctgcagaccttacgaaagtgcccacatggcccggcctgggagcctttgctcatactgctcccattgaaaacgcttcctggcacctccactcactgaaccctgcccatttttgcaagctctactcaaacactatttcctcctttccagattgtcacagtcatttgtatcagtaccatcaccctttgcatttctgcatggttagttaactgtgtgatccttctgccctatgaaattcctagatcctgtaagacaggagccacgccttagccgctctcatagtcctttgatctgtccacagtgatcaatgtcctgtctagcacataataggtacttgacacatttttgttccattgaaccctacagtgaatgagttcctttgtaaagtgaagagccacgtcataacaaacaattataatgatgactgacacttgtatagctcttaactgtgttcaaggctatatttgaaatgctttacaaagactgactctttacaataaccctatgagataggtatgattattcccgttttacggacaaggaaactgatgcccagagagatgcagcaatgtgcccaaggtcatagctaataaataatacaaactcagtctgtctggcctcaaagactgtactcttaaccacagtgtacactgtctcacctgccgtacagtgtaacaacgtgcactgcctgcagaaatattcggtacataccgattggttgattggctgcttagtttcctgtaataagtatctacatcttctgttttgtaagtgccgtttctgaataacaccttataaatgaattacccttaaatattcattctgtgtgcacattttgtatcagaatcaatctataataacagttacacgactatgtttttggaaaggaaaaactacttcattgcctctagtgatattgggtgtgtatttatttaataccactgcaataaagcccccgtattgtattattattctagtacgacgtagtcctttacatccgccgactgcatatttcatcagcccgcagcgtgaggcgctgttttaccttcaagttcctggtccctggcttagctcaagtcacttccatcagctggaaacaggcgagcacctcacgccatctagcggagacacactttgaagaccgcttcaagggatttgcttaattatgggagtctcataggggcaccatccaacagccacatgaaagtaacaacagacactgagtaaaaccagaatgtttcccccaataagtggctgctctaaaattattttcccaaactctcccaggttgctgccccttgttcctgagtccacacagcagcttcctacggaaaacaccctctgtgattctagaagagcgcactctcctcatccattgaccacaaagacttactttctacacgatgtgaggaaggaaaacaccctctgtgattctagaagagcgcactctcctcatccattgaccacaaagacttactttctacacgatgtgaggaaggggctcccggcagagtcagggtcactgcctggtgcctccggagaggctgcaagttgtcatggaaagcacaaatgtctgtgggatctaacaaaactgaagagcttctgcacagcaaaagaaactatcatcagagtgaacagacagcctgcagaatgggagaaaaattttgcaatctatccatctgacaaatatctaacattcaacaactacaaggtacttaaacaaatttacaagaaaaaaaactccattaaaaagtgggcaaaggacatgaacagacacttcttaaaaaaagacatacatgcggtcaacaaacatatgaaaaaagctcaacatcactgacgattagataaatgcaaatcaaaaccacaatgagatatcatctcacaccagtcagaatggcaattattaaaaagtcaaaaaaacggcagggcacagtggctcacacctttaatcctagcattttgggaggcttaggcaggaggatcatttgaggtcaggagttcgagaccagcctgagcaacatagtgaaacccactctctactaaaaatacaaaaattagtcgggcctggtggcacatgcctgtaatcccagctacttgggagtctgaggctgaggcactcccaactgggtgacagagttagactctgtctcaaaaagaaaaaaagaaaaaaactcaaaaaaacgacagatgctgttgaggttgtggagaaaaaggaaagcttttacactgctggtgggagtgtaaattagttcaaccactgtagaagacagtgtgacgattcctcaaagacctggaggcagaaataccatttgacccagcagtcccattacttggtatatacccaaaggaatataaataattctattataaagaaacatgcacgtgtatgttcattgcagcactattcacaatagcaaagacatggaatcaacctaaatacccatcaatgataggctagataaagaaagtatggtacatatacaccatggaatactatgcagccataaaaaggaacaaaatcatgtcctttgcagggatgtggatggaactggaggccattgtcctcagcaaactaacgcaggaacggaaaaccaaatgctgcatgttctcactcataagtaggagctgaatgatgagaacacatggacacatggccgggagaacaacacacacacgggtctgttggagggtgggggatgggaggagggagcacatcaggaagaatagctaatggatgctgggcttaatacctaggtgatgggatgatctgtatagtaaaccactatggcacatgtttacttacgtaacaaacctgcacatcctgcacatgtacccctgaacttaaaataaaagttgaaaaaaaagaaagtataaatatgtgatgcatagtgacccttcctcagctaaagccactcacctttgttatctatgcaaatgctatttgaatgtgctaatctgagcttggcagcaagttcaagggcctccccaagattcttgcaatttctggggcttattctaatggtcactttgactttctttcatgttcaactcccaacctcagcactctccttcagtggctgctgttatcctataccaagatctggtttccttctacttccaggcacagggaagattgcaatcccccaccctcttgaaattaagcatggccatgcgccttgtggtggccaatgaactacaaatgaaaacgccatgcaacacttccaggtagaagcattcaacccatgtgctcctccatgtttccctgctccctgccacatgccttgcctctttcagcctgggccactggagtgagggccacacagagcagagcccttggcccaacaaaaatggataaggagtatgtccaagaaaaagcaagcttttgttgtttaagccactgagatttggggattgtttgttaccaggacatagcctagcctatgctgactaatacacttcccaaagtaattctctctgtgtgtgtcttgcctgcacagatagagccatggaatatgactctcttgttttttaattctccaaaatactactcactaaagacatcttggaatataggaagcattttttaattaggcattattcattcttgcttttaaagatttttttgcccaccattctcattgccaaaacaacccttccacactccttttgtctcttctaccctcaactcctacagcacacaaaacattttagcaattcctttgtctttttgtctcctcttgaaccaattgttctcaactgtgtcagatctaatgtcctgttttttataataaatattttgacactacctctgctaccccaaaaataaaattaatagataatgtaccttatctagacacatgattttaaaaattgaatataaatttttaattgtaatataaaggaggacatgtccataataaaatatgatttttaatagtcacatacttgggcataaccacaggagaagacattatgaaggagtcggatggttaccaacaaatacggatcaccatgcctgcaacactacaaattcagactaacagagatatggggtatgggttactcatgtaccctaagagcaacagtggcaactgtgatgttacttttttcaagtggtgaacatttcttgattcaaagtacaattaaccttgatttactcagtctttgcattccctcaaaattcaatgtatatgctatagattgcatgtttgtgtcttcccaaaattcccatgttgaaaccttactcccagtggaatgatactagatggggttttggaaaggtgattatgtttaggtgagttcaggaggattaaatcctcatgatgggattactgtaatcccagcaccttgggaggctgaggcaggcagatcacgaggtcaggagatcgagaccatcccggctaacacagtgaaaccccatctccactaaaaatacaaaaaaattagccgagcttggtgacaggcacctgtagtcccagctactcgggaggctgaagcaggagaatggcatgaacccgggaggcggagcttcctgtgagcagagattgcaccattgcactccagcctgggtgacagagcaagactccatctcaaaaaaaaaaagaagaagaaaaagaaaaagacactagctcttgctttctccaccatgtgaggatgcaaccagcaggcagccatctgcaagctgggaagggagcccccaccagatcccagatctgccagcactttgatcttggacttcccagcctccagagctgtgagcaataaatgtttgttgtttaaaccactcagtttgtggtatttttgttatagcagcccaccctaagatagtatattaaaacatttcaaaaatattatgtgaaacagaattaggttataggaccaaagaatttttaacctgcctttcacttacacttacacaatatctggcaaggcacttgtattagtctgttttcacactgctgataaagacatacatgagactgggcaatttgctaaagaaagaggtttaattgggtttacagtttcatgtggctgggaaagccccacaatcatggtgaaaaggaaggaggagcaagtcacatcttacgtggatggtggcaggcaaaagacgagagcaattgtgcagggaaattcccctttttaaaaccatcagatctcatgagacttattcactatcacaagaacagcatgggaaggacctgcccccatgattcaattacctcccactaggttcctcccacaacacataggaattcaagatgagatttgggtggggacacagagccaaaccatatcattccacccctggcctctcccaaatctcatatcttcacatttcaataccaatcatgccttcccagcagtcccccaaagtctcaactcacttctgcatcaactcaaaagtccacagtccaaagtcccatctgggacaaggcaagtaccgcctgcctatgagcctgtaaaatcaaaagcaagttagttatttcctagatacaatgcaggtatatgcattgagtaaatatagccattccaaatgggagaaattagccaaacaaaggcactacaggccccatgcaaatccaaaatccagcaatgcagtcaaatcttaaagttccaaaatgatctcctttgactccatgtcatgcatctgagtaacgtttatgcaagaggtgggttcccatggccttgggcagctccatccccgtggctttgcagggtacagccaccctcccagctgctttcatgggctggtgttgagtgtctgcggcttttccaggcacacagtgcaagctgtaggtgggtctaccattctagggtctggaggactgtggccctcttctcaacagctccactaggtggatacccagtaggcacctcccatcccacatttccctgtcttattgcccttgcagaggttctccacaaggacaacacacctacagcaaacttctgcctgggcatccgggcatttccacacatcttctgaaatctagagggaggttcccaaacatcaattcttgacttctgtgcacttgcaggctcaacactatgtggaagctgccaaggcttggggcttgcaccctctgaagccatggcctaagctctagattagcccctttcagccacagctggagtggctgggacacagagcaccaagtccctaggctgcacacagcatggggaccctgggcctggcccacaaaaccattttttcctcttaggcctctaggcctgtgatggaagaggctgctgtgaagacctctgacctgccctggaaacattttccacattgtcttggggattaacattaggcttcttgttacttatgcaaatttctgcagccagcttgaatttttccccagaaagtggaatttccttttctattgcattgtcagactgcaaattttccagacttttatgctctacttcccttataaaacttaatgcttttaacagcatccaagtcacctcttgaatgctttgctgcttagaaatttcttctgccagatagcctaaatcatctctctcaagttcaaagttccacaaatctctagggcaggggcaaaatgccaccagtctttttgctaaaatatagcaagagtcacttttgctcaagttcccaacaacttcctcatttccatctgagaccacctcaacctgggctttattgtccatatagctacagcattttggttgaaagccattcaacaagtctctagaaagttccaaactttcccacattttcctgtcttcttctgagcccctcaaactcttccaacctctgcctgttacccagtttcaaagtcacttctactttttcgggtatcttttcagcagcataccacttctggtaccaatttgctgtattagtccattttcatgctgctgataaagatataccagactgagactgagcaatttacaaaagaaagaggtttaattggacttacagtttcatgtagctggaagcctcacaatcatggtggaagacaaggaggagcaagtcacatcttacatggatggcagcaggcaagaaatgagcttgtgaagggaaacttccctttttaaaaccatcagatagtgtgagacttactcactatcatgaggacagcacaggaaagatctgcccccatcattcaattacctcccactgggttcctcccacaacaggtgggaattcaagatgagatgtgggtggggacacagccaagccacatcagcactcatatgttttgtgttactaaagacaattctttatttttaagtcttgtcctgtgcatagcaggacatttagcattcttgacttcactcaccaaatgctatcagtctttcaatcatcatagcaaccaaaaaaataaccccataaatttcccaaatgaaccctggtggaagttcacctcatggttctaaaatattccaaagtggaactcatcttttatcacaaatcaagggtgtatgtgtgtttatttttacttttgtatttatacatgcacacacacactcacatgcacaggttaagttctcactttgtgttatggtgctgtaaacatcatcattgaggcagatgttgtgcaaactaattttaatcaacaggataaattacaattataaactgatctttaaatcgttttcaaaatattaaaagctttgttcctgtcagttataaatgcatagaaaattttttaaatgataaaactatttaaaaaaccatatattaaaatattaagaattaaagtactttatatatttgtttaaaaacttattcatagtagtttgagaagggctcattttcttctcgttgtacaattttggatcctaagtgagcaacttgtttatgcctcaagaaattgtcctacccctttctaagtttgaatccacttccagtgtgtgtgtgtgtgtgtgtgtgtgtgtgtgtgtgtgtgtgttttcagtggtcaaatatcttcagaacttttttacaatgtgttttttgctggtgttctttggcttgctttctccaagacatcatacttttcatcacaaccactttcgttatttctgtcagtaaattcaccttctcaaagtctctctggctgcacacctagagtcttgaagtgggggcagggtaggggcaatgtcaaccttcccctggtcagctatttcttctataactacatttatgatcaaactcaaattttactcccagcattgtcagttttcttagggactttcatttttattagccattctctctttcagttatccatttttgtaaagtgtcacatgagtttatcactgggagataaggaagaagcacaagtacatactttgctgtctgtgcatgaacccaagaacagatgtgcagtgaccaagactgggaaaagaatgagaagctgtgaggccattggtcaccaatcatgcttctatgcaaatagcagatgcatcatcggcatctgctattcacacagtgatttttggatgagagggctggtagccaagtgtgtgctctgtgcaattcctcacatggacatgctacagtaattgaaacttaaaccatgttgttggtggactagtgtcatttaactaaatcgtagtaacgtaaatccatgcatggcaaacaaggactgctgcgatataatattctatatacagaattggattttctggagagatgatataccccttccttaaagacaaaagcagcttcaatcagttgtgatttcaagcatgatatttttttcttgtctatatagacacagagtaatactcaagaaataggagcccactgtgcagataaattgacaacctagtttgttttttgttttttttttttttgagacagaatcttgctctgtcgtccaggctggagtgcagtggcaccaccttggctcactgcaagctccgcctcccaggttcacgccattctcctgcctcagcctcctgagtagctgggactacaggtgcccgccatcatgcctggctaattttttgtatttttagtagagatggggtttcaccgtgttagccaggatggtctcaatctcctgacctcatgatccacccaccttggcctcccaaagtgctgggattacaggcttgagccaccgcacccggccaacaacctagtttctatctagaagaaacaaattatggtaagtttgtttatatagatcaggtcctatataaaaaataatgccatacatgttttaaagggccaattttttttgtttttcttattgctataacttaaagaataccctagaaccacactgactcaaaattcttctcttgttggtctgcattttatgctgccttcttttcaaagtttatctcaaatggactctccaaataaaggaagaagaaacctaaacaagaggagagaggtgctctgaggcaagacggtaatgggaggaaggctttttctagctttctgttgaattatggaaacttcacagtccctagaattcatctttcaatagcctccatctccaatgcaagaatcccttcattcccttcctaaaatctggtcttacagcctctgtttagacacttcaatagcagaaacactaataataataatattattaatagctatttaatgggaatttgttctgttccagttattataaagatctttacatgtgtcatttctcatcatctttaataacataatatttgttagatgatgattttcatttttgactcagaatctctaaaaccccatttccttatgccatttccatgccccactttccttgtagtggattaaagatggtcccaaattccttgccattcttctaatcagaggtggggtttattgcctgcccctccccttgaatcatggctgtccttgagactcgatttgcccaacagaagtgcaacagtgtaatttccaaatgatgggccttgcaagatagacaacttcatttctgcacactgagaatgccccttcttgaacctcagccatgtggggagaaggctaggtcatgtggggaggccatgcagaggagaaccgaggtgctctggtcagcagccccagctgtgctccctgtcaacagcaccaatggccagccatgtgaactgagttggatgttattccctagccgaacctctgctgaccatgggcccagccaacagaccatgcagcagaagaaccatccatctgaaactagtcaacccacagactcaggagagagattaaactgttgctttgaaacactaagttgtgcagcagtcaataattgaagcattctagaggcaataaccctctagaaatacagtgattaagcccagcttcacagggcagtttggcccaactgactaccaggagaagcttgtcctggcccaatgaatcctgcctcactgcacctcaaaggaatgtgctggcaggtgcccagcactcatggggtgagttccagaacggccagaatggcctggcttcactcacttgaacgccctctgccacagccttgtttgcacagtgtggacctcacgcattcttctgccacatagactggcacattcttcaaacttctgatttcttttcccagattctgactttattccttaattccagcctgaagtctccatagaaaaataaccccgtaacgaacctcctcaggcctcgcacgtggatcattgccatacttacctcaccttctcatttttcttgaactgtgtattaatagcatattcttgtgcaacagttttgaatctctatcctgacccaccttcaatggtttaatttagtaaaatcttttatataatattccactcagaattgaatgtgatgttttaggtatggtctacactggagaatgcactgagacttttctgtagcacttctagaatttatattcagcataccttctttttcaccattcatgtttatttcaagcatatttcatttgaaccactttagtgaattctagggccctgtttcttaccactaaattaatttcttcaagttaacatcattgtagtcatcaatgcttttctggttggatttgttcaaacaactggttctataattaaccagataaaaattcattccattttcatttcctacctcatccatgataaacacattacagtcgatctatgcttatcgaatctggatctgccagtttagaaacagcacagcaaagaggagtaaaattagctcaacttaatgttcaaccaagcactgtgtcaccaccaattcttcaggcagtaaatggccccttgccatttgcaagctctaaaatccaagggaagaatctggctatgacatatgggaagtgtttatgggttatgtgtgtgttaccagctcctggggctgctgacaagttagtctccctctcaatgtctgacgaggactgggcccatgtctcgggcttggactcaatatctgacgaggactgggcccatgtctcgggcttggactcaagcccgatatctgctatgcctgaagacgtggttcctgttgcctcctgagacccttatgaaggccttggcagcatggagtgactcatgcctgtaatcccagcactttgggaagcctgtgcaggaggatctgttaagtccagaagtttgagacaagcctgggcaacataatgagacccagtatctacaaaaaaaacaagagggtcttaacaccatcttctctgcctagctttatttccagactctgccccctttgcccccacctcctggactgtctttcctctgtcctcattggtgtgaggaccctcccactgcacacctattctcagtgcccagtgagcttccactttgtccccatcccatagctagtgagcctcagtcgtcaaacccctcccatacacacgtgtcaaatttcttccttttcaaaagttttctcaaaccatctttttaatcactgcatgtcattttttaaatcaagtctactataagctcgccaatctatatttacagaaatctagattttttcctttttgaaaactgaagtaatctaatagtcatcatttacaagcattttcaattcagaacttctttctgtgccctgccgtgtaattagtctgggaaacaattcatttaaatgacttcaggccgggcgtggtggctcacgcctgtaatcctagcaccttgggaggccggggcgtgtggatcacctgaggtcaggggttcaagaccagcctggccaacacggtgaaaccccatctctactaaaaatacaaaaattagctgggcatggcagagtgcacctgtaatctcaggtactcgggaggctgaggcgaggagaattgcttgaacccatgaggcagaggctgcagtgagctgacatggcaccactgcactctagcctaggcaacagagcaagactccatctaaaaaaataaaaataaatatgtagagaccaggtcttgctatattgcccaggtctcaaattcctggcctcaagtgatcctcccgacttgacctcccaaagtgttgggattacaggtgtgagccactgtgctgacctgttttaacactactactagtaactagcacttagttagcacctaatgtgttccaggaactgctctaagtccttcatacatactcataggtgagtattatttgttattcccatttttcagatgaggacgttgaggcatacagagatttgccaaaagtcatgaacccagctcgttagtcaaagaggcaggccagggaaggggttgatgacgacgctgccgactcacactgttcagtccattttccatcgttaccgccaacctcggccctgtatcttgaccctactccacttctctagccacagcctggcatggtacttaatgtggagaaagtctgttttctatacgtatttgagctgtgataccttccttctgattgtaaagatattttcttatagcttcttcaaggattgtctatttgaatttccaaagatgacattcaattactctgctacatcttttcccctctcttggccacatgacttaaccactctgagcctcactttcatcatcttttaaattagaggatccagctagataacctctaacatccctggtggctcagatatccaaacacactcttcgccctgtttacaccttggagggagccacaattactcatatgaaggtgcttcccagcctgtacctgaaataccagcaccagatcttagtgtgatcgtgagaccacttccagatgagaccccttcctcgccagaaaacacccagacaccctgggaggaacagcaaaagctgctacactggaattgacctatcgtggctggtcacatgtctactctactctcgatttctctactctggcaatggatttgaatttgaacttcagaggtaaggaacacagaataggaaagaactgaaatggctcaacagcaaagccacgtttccatggcttaagaaccaatgagagaatccgttccatgctctctaacttcccatttttggcttgtgatactgctattcagtttcaaatatttttcttttgaaacatctttatgttctggcctcaaatgatacaaacccacacctggccaggcacagtggctcacatgtaatcccaacactttgggaggccaacatgggtggattacttgagtccaggagttcaagaccagcctgggcaacatggtgaaacctcacatctacaaaatatacgctcacacaaaaatcagctgggtgtggtggtgtgcacctgtagtttcagctactcaggaggctgagatgggaggattgcttgagcccaggaggttgaggctgcagtaagccatgattgcatcactgcactccagcctgggtgatagagtgagaccctgtctccattaaaaaactaaaacaggctgggcgcggtggctcaagcctgtaatcccagcactttgggaggctgaggcgggtggaccacgaggtcaggagatcgaaaccatcctggctaacatggtgaaaccccgtctctactaaaaatacaaaaaattattcaggcgtggtggcaggcacctgtagtcccagctgctcgggaagctgaggcaggagaatggcgtgaacccgggaggcggagcttgcagtgagccaagattgtgccactgcactccagcctgggcaagagagagactccatctaaaaaaaaaaaaaaaaacagaaccaaaaaaaacacacctctgcattacagaggacaaaaaaatgtagcagagtaatcaaatatcatctttggaaattcaaacagacaatccttgaagaagatgtaacaaaatgtcttcacaatcagaggaagccatcacagctcaactatgtgtagaaaacagacctgctccatgttatgtgcaacctgacccaccaaacaagcaggtcagggtcaaatatagctatttttctggtgaattcatccagctttgactttggacttttacaaacatgctctttcacaatgacagggctggagctgaatgctataaatgtgaggcagctattgttatactgtcagctaaaccacaatgacttacactcagtgatgaatctcaagtttgttgatatttcccagagttcccaatgagtactaaatgttatctctttgttcaaacattatgaaatattgtgattttttttcttgtagatttcctactgattttcacatacgtgaaagtgaatattcttgtggcatttatggtagtgatttccatcctagaaatcagtggatatattcaattcaccacgtcacagctgcccaggcatgatgggaggggttggcagtggggtggggagtgcaaggggaaagggtctcaggttcaagactcagtagcctgaatacacagcctacgcggtcgtgcttctgaacattgagagagagagcaaatgttgttttgttttgttttgttttcaagaatttgggatcaggctgagcacagtggctcacgcctataatcccaacactttgggaggctgaggcaggtggattactcgaggtcaggagtttgagaccagcctgaccaatatggtgaaaccccatctttactttaaaaaaaataatacaaagttagttgtggtggtgcacgcccgtaattccagctacttgggaggttcaggcaggggaatcgcgtgaacctgggaggtggaggttgcagtaagccaagatcatgccattgcgcttgagtctgagccacagagtgacgctccctctcaaaaaaaaaaaaaaaaaaggactttgggatctgaagacagagtatcagcatggaaaaaagtccagcctgcttttggtttggtttattctgagataattctgaatatcagattaaaataatcagaaaggaaatgatcaatggaaggaggtatgattttgaaagtcactgctgtttttgggagaacatgccattgggttttttattatttatttatttttttcttttgagaccaagtcttgccctgttgcccaggtggaatgcagtggcgtgatctcagctcactctaacctccgcctccccagttcaagcaattctcatgcctcagcctcccaagtagctgggattacaggcgcatgccaccacacctggctaatttttgtatttttagtagagacggggttgcactatgttggccaggctggtctcaaactcctgacctcaggtcatccacccgcctcagtctcccaaagtgctgggattacaagtgtgagccaccgcgcccagctgccattgggtcttaattctccagaaacagtatctcagtcaagaatgcaaagctgtggcaggatttttccatgaggggtccactgaggcactcactggccaaggtgggcgctcaactagtccaacctaggcaagggaggggagaatctgttttctcccttccattatttcagaagttatgtttctccagcagacacacggctgtgcaatttcgaagactgaggggaaactagggaggaaaatgcagaaaactctctgttgcatgccctgtgaattgggctttaaatgtagcaaggagctccaggatcccagaagttggcctggggtgcttggtcctgaggataagacaacctcccttgtattgtaattctgcccacagctggagcttcctatttcagtgttgcatccaagaagttacatttcctgtttgttgcaagaaaaatagaatctgaccaggatggaggctaggcatgggggctcacatctggaatcccagcagtttcggaggctgaggcaagcagatagcttgagcccaggtgttcaagaccaggatgagcaacatgatgaaatcccatctctacaaaaaatagccaggcagtgtagtgcacacctgtagtccagctactctggaggctgaggtgggcagattgcttgagccgggggaagttgaggctgcaatgagctttgatctcaccactgcactccaattctgagactggggagtattgatttgccactgacctgagcccggctgataggggcagcaggacagacactgttaccttaatcaaagacattcacgaagcattctcactgaagatctgccctagtatcctgcacagccacttgcctgggtctttataggtaacaggtagacagtcatcaaagagataggggaaaacatgcacaatgaattctttgctcagaaaaacccttctgtgtcttctcccactttttctaaatttttcctgctttcatttagatcaaaggattttgtttcttggaatagttctgcacttggtcctttagaaaggatgacaattatctgtaggtctctctgattttaagatcaatagaaatcagcaaaagccaaaaaataaaaaataaaaataaaataaaagcacacaagcacattcaagcacatccatctgcccctgacttgtcctcacagtaagcaactgcttctgactttgctgtttgaataacctctgggtgttcgatccacccacacagctcaagtttgagctccagaacaaatatttgtcccaattttgaacaaagttagagagttttttcttcttttttcttctttcttaaagcgaactgtactcctctgctgttcctttgaacttggttcagtaggaagaagtgatatcctccccagaccatctgctttggggagcttggcaaaactgtccagcaaaatgaaaagactcacgtgctttttcatctgcttctttctttctgaagtatcaggcttcgaaatccccataaatggactttctgaagtaagtacttacagatcactccttgctgttggcttgttcatgagctcagtaaatcatctattggaatcgctattcaatggccttattctgtgtgtaatggaaacttaagataaaattcatctgagtgcaagtgtttactgttataattactggaatgtatatttaccttttaaagcattaacaggttttgcatgaaaattaagtcaagatcaatgggcaggcatcagagcgtagcatttatggagcagagctgctcactcctcacctaaaaaattgggggtaagaatagacctaacccaatggtttgctttgagaattaaatgacacagtgtaaactcttctagcagagcgcctggactagtaagtgcttaataattactagctgttatgatgatgaagaaatattatcactcttttactaagagtataagaaaagtcattatcaaagcacactgtttttcatatctaagtgaacagtgatatttgtaataagagcactttaagtattcctattaaagcggaagatagcaggcagggtggaaaagtacaagaataattcccatggagtacaggtctccacttttgtcccttagccatctccaatgtaaggaaagtcttggactgaaagtctgtttctgaaagtcatacaagagctatttttatgccagaaaagcgaagcatgttatgggaacatcccagcaaatgcaaaggcttataatacttgcagagtggattacctataaaaatgccagagaatatgacggcatatttacaaagggaaaatatcactctgtctgctttgaaactatcatattttccaacacttaaaagccaccagagtgtgttagaaatctcaaattgaagccaagacatccaaatgtgtttgtgctttttcagtcatttctaactggcatttccttttagaaaatacctacatttttaacttggggagatgtatggttcatgtctgtccagtcagacactgcaaatgcctccagggtctacccagatacttccccagacacccacctaatcactgggttgttttgatctctgtcttaccacctgctggcaaactcaaaaatgaattcccatgtccaacaaatgcgaaggtgttgttaccctccatttggacacctctgagacgtaaccagcaaatagaaatatactaaagaaatcattttatacaaaattgtgattgcccagaggtagaggaaagaatataaaataatgaataccaacagctatctctttggctctagatcttttggaaatcatcattctcagcaaagtaacacaagaagggaaaacccaacaccgcatgttctcactcataagtgggagtcgaacaacgagaacacatggacacaggaaggggaacatcacacactggggcctgtcagggggtggggggctaggggagggatagcattaggagaaatacctgacgtaaatgatgagttaatgggtgtagcaaaccaacatggcacatgtatacctatgtaacaaatctgcacgttgtgcacatgtaccccagaacttacagtataattaaaaaaaaaaaagttaaaatcctaattttttttaagtttgtagactatgaagatcttgtggaactggccccaggcaaatttcaattggtggcagagaaccggagatatcaggtatagtaaggtttactcccaaaagggggaaaaaaagtgaaagagattatggcagaagaagacaagtgttaagatgccttctgctagattttcttaagagtttgttttttagcacagaagagtccagacttcttacaccttggtggaagagatcacccaggtgaaataaaaagagaaactcacacaactgctcagcagccttcacaccataatgctcaatttagtcccttaaagagtacacgactcagcacagtggctcccacttataatcacagcattttcagaggccaaggagggaggatcacttgaggccaggagttccagatcagcctgggtaacatagtgaggctctacctctgccacccagctaatatatatattagctggcatgcacctgtaatcccagctatttgagaagctgagatggaggatcacttgaacccaagagttcgaggctgcagtgagctatgattgcaccagcctgggcaacagagggagacgctgtccccactccatttaaaaaaaaaaaaaaaaaaaagaatacatggctatgtgttttcttcaaaacttaagattccgaaattatttcctgccttgccggaaggatttcctgttaggaagacttttcttattttagcgatgacagacactcccccttgcagcctcacaatctccttcctctggtcactctgagggcacctgagaaggagaattggccacattggaagttgcaatcctggcggccaccagcagcagtatagacaaaaccctctaattaagggggtgagttttccagaacaccaggaagggcttggcttcttccccacggagcccacatgctgagagaggaggtatttacggaagcagcaaccctaagctgatcaatgtcttattttgtatgggtgtgaattttttactttctgaaaatccaggatttttttttgtagactaataatattaaaatccaataagcaagacttcatgtcacaatttatttagccacaagagagaaaaatttgtcattgagcattgcattcaagaagtctacaagaagaggtcaaccattgacctcaccatgtcacacagcacagaacctcagttcaccccgaatcaggcaagctgagcttatatccaacacccgacttcttggatctattattaacagctcaccaaacattacatgttcacccaccacccttaagccattcactttcaaaggcaagggaatcgcctttgttcatttcctcaggacagtcaagtgtatggataatctcctagcatggtggttaaaagcatagaattttctaggtgccagtcactgtgtttgcctcaggggttacactgtggaggaaatacatgaaaatccctgcttttatgtagcttagtttaaaggaagagacagactttagtcaaataatccctcaaatagaatgaatcattatgaaacaaggtgagcactctgcaggaaggaatatgctgctgcaaaaacacttagtaaaggaaaccgacctagtcttggggtgttagagattttcactggaggaattctgctggagctgagatctgaagggtgagtaggagttctccatatgggggttgaggaacctagcaggggcactgcaaacagtgggaacagcatgcccacagcctcatggccgaatggaggatcaaagtctccattcaactgagtaaaaaatagagcaaatagcatcaaggggatatacgctacccaggatgcatttggttgaatatttttatttaaaaattacttgttctagcattatatccaagaatgacacacacgccaccagaactggttgagaaacttattgagaaactcaccagtgggaaaatagttttcaagaatattcaatatttatgtctcaactccagtgaatgaataacagctcagtattgaagaaaaataaaatttcttttttgactgagaaaacggttttggctctcaaggtaataagtgacatacagttgaagaatgattgtctaacttcctttcacagagaagccttccaggagaatcggaagaaatgatggtaagttgacttgatgttgttacagattgaatgattttcctgttaataattaccaggaaatcaatctgggtgtctcttttttcttcatcaccgagtatttacctgactttcgaaatactgccttgcccaactgtttgcaagtgtttctaaaattcagcattgaagagtgcagtctttacagacaggagagaggccaccaagagctgaaggggcccttctcttcattttcttgagttttgccatatatcataggttccttcccactgtataaatttatgtatttattcctactcaacctttttgatttatgtatttatttttacgttttcatttttatttttatttttttgagacagagtttcacttttgttgcccaggctggagtgcaatggcatgatctcagctcactgcaacctctgccccctgggttcaagagattctctgcctcagcctctcaagtagctgggattacaggcatatgtctcctcgcccagctaatttttgtgtttttagtagagatggggtttcaccatgttggccaggctggtctcgaactcctgacctcgggtgatccacctccctcagcctcccaaagtgctgggattacaggcatgagccattgcttccagcaccattttgatttaaagtatgacacctgacagctttggaaaataaaagagtgcccgtggaaaggaacttttaaacacaaaacggcccagttccctgagatgttcagagtagaccatcctgtggcaagaaaacagcctgaggacaagtggcttatgttgtgcttcctgccctgaattggcagaaactgccagaagtgcacacttcagggggaggaaggacacatagattagcctggattttattttagcttgaggtgagttgcatggttaattagtcgaaaggtttaatgttggactacaaagtttggggaatgagacctggtattgagataagtaaattcttttggagaaaaaagcaaaatctaatgggtctcatagttgtccatagacctgaaggagcttgcagctctcagtcacctcctgaaaggtgtgggtttctaggaccttgcctttgagcacacttacatatgtgattcttcacacaggagctgctttaaatcagtagtgatcgggtaaggaggtccagagtgttggaccaatacttgcatcagaatgccctgtccaagatcaatgtctcttgcttacacccgtcactgttctcctagcttgttttgacttgggggaggagaaaaggactgcagatgaaattgtaatagaggagattaaagaaggtagagagctgtaagggggggttggtggaggccatatgtgtgtttccaccccacagcacccctgtgtgacccctactaaagatacaaccaagttcctctttcaacctcgcaatccagtatcctctccccagctgatggtcttgcatttggagttattacctggacttcctcaatccaatctggcttcccacaccgttttctacttgtattctaatttttgaaaaatcattatttatagactcatagggctgaaaaatgccttttagctcaaagtatcttgaaaccaaggcagacttctgctcattgcgggttccaagaagttaggagaatgcttaaccatacatgaattctgtccttaccaaggccctggaattgttctgctagtaaaacaagtaaaatgtagtgttgttaacatcaaatgcactacatttgatgaagttctgtgtgatttttctatcagtacagttatgctttcttgccaatttcaggaagaggttgatcaagtaactctttatagctataaagtccagtctactattacttctcggatggccaccaccatgatccagagcaaagtggtgaacaattccccgcagcctcagaatgtcgtgtttgatgttcagatccccaaaggagcattcatttccaacttctccatgtgagtaacttctgtgtagagccagaaattgtaggtgctctactcacagaatcaaaacccctcatagttagaatggactttagtggtcaactgtcccagaggaccggctggatgtcaagggtcattgtgaggttggtcccaataattttctcctcttcaaagcgttagaacttgtgaattatttgctttttgtttctaataagctaaagcaaacttaaggctatctctgtggtaacaacctcatacttacttgcattttaatatactttctagggaggagaaaaatatactgggttgccctggcttataggaaaccacataagagcgtgtgcacagcaggtcaatgccatctgccatatgtttctctatgggaaaaaaaaaacaagttgagaaccacagattaaatctaattacttatccagtgcttgacctcctctataacaccgctgacaagtgtgtgatgatttccttgatgataaactcacttttcccaaggcaatcaactcagtgattgacagctctgttaagagtcctttcttatacttcaaatattttccactttctacccaatgactctagtgataatcacatagaatttttaaaaagctctctacaaaatacatattgaagtgttcatagatgaaatgatgtgccatctgagcttggcttcttttttttttgagatggagtctcgctctgtcgcccaggctggagtgcagtggcgtgatctcggctcactgcaagctccgcctcccgggttcacaccattctcctgcctcagcctcctgagtagctgggactacaggcacccgccaccatgcctggctaattttcgtatttttagtagagacggagtttcaccgtgttagccaggatggtctcgatctcttgacctcgtgatctgcccgcctcggcctcccaaagtgttgggattacaggcgtgagccaccgtgcctggccttgaacttggcttcttaacaactaaggtggaaagcatgagagtacagacaaattaagattggctgagtattcataatggtgtagctcagtgatggtttcatggacatctcatattattccctctattttctgtgtgtttgaaatttttcgtaataaaagaaggttaaactactccaatactttccaaacagttaataccagttatccacttggagccttcatgtatcaaagttaaatattctctgttcctctaagtgattggaatgatttctatgtccaaatatcaaggtggccaacccagagtatgttccaggtggtcaatgtccctcttaagttgccaagaacacagcaaagtactgtgcataaagtctggctattttttttttatgaagacattaggttgaattacttctcatccacttttgtctttcatacaccaaggtaatcagtgatcattgtggataaatagtaaagggttcaaccaccatgtactttggctgccgaaagtggcagtcatgtgaactctaaccaaataggcagaaaaaggcattgtgtcactttaattggtatcctttgaattggctttaaaatgtatcactttttttgtctgccttttctaaaaagcaaagggagaaggaaaggcttttctgtactggtattatatgaccccatgtctagaaatgacattgaaaactattttaataaattcctatttttaaaccacacaatcagaatttactcaaaagatctcttatttctgttttccttcttttttttttttcttttttactttaagttctgggatacgtgtgcagaatgtataggtttgttacataggtacacatgtgccatggtggtttgctgcacctatcatcccatcatctaggttttaagccccacatgcgttagctgtttgtcctaatgctctccctccccttgccccctaccgcccgacaggacacggtgtgtaatattcccctccctgtgtccatgtgttctcattgttcaactcccacttatgagtgagaacatacagtgtttgattttctgttcctgtgttagtttgctgaggaagatggcttacagcttcaaccatgtccctgcaaaggacatgatcttattcctttttatggctgcatactattccgtccttcattctgttctttctttactatctcattacatagaagatttgaagtacaaaggacagaatcgtgaaacatgcatttacttttatctccctctgctctgagctgaatctataagaccagagaagatacctgcttaattatcacaacttaaaatgagctgtgtagacctatgtactagccaaaatatcccttttacctttttatcaagatcttgaatattctatgggagatgatttcctttgtcctaaagaccccttggcctttgagacttagttctgattcgatagaagcatgatggccttgaccagcagtgtgaccttggcaagagtcacctgtctcctggggtctgatgtctctcatctaaaggggcaaacccacaagtgtgcctcaacacacgtgctgttggcatttggggcaggaaaattcttcagtggagctgtccctcatattgcaggatgactaacattcgtggtgtcctcccacaaatgccagcagcacttccaagtcatctcaacaacccaaacttcacacatttccaaattgctccttgggaaagacactgcccatttgagtactggaagttcccatgtacttccaaaattctggattctaccactctgaccaaccattacttggtaaggattaggtgctagccagctaaaggtaaggtgtatagagatgagatgcaaatagaagacagaggtccccaagggagatggtttccagataaacaccaccttggcaggggacccaccagcaccttccccctttttctttattcttttccacccttgcagaggagcataatattctgtcttcatcagctccggctgctatgactaagtaccataaaatgggtagattataaacaacagaaatttaaaattcatagttctgaaggccgggaagtccgagatcaagatgcccaaggatttcgtgtctggtgagggcccatttcctggttcagtcaagatggaaagagatgagagagctcttcgaagtctgttttttatgacagcactaaatgctattcatgaggagagagccctctccaaggccccacctcgtaatgtcatcgtcctaggaagtaaggttcaacatgcacatttgcggggaacataaacattcggtccattgcataccccacagcgatgccaaattcttagctcacagaatgacctgatgaaccagtaatgagataattcggaatttatcagtcacctcccctaatcacatttgtcattcaaaggggatacccaaagagaaccatccttaatctaaaggatgaaattcaaagatgaggaaaaatctataaacaaacaacagtacatgagggaaaggttttaggatgggagcctaccaaacccctctcaagccacactatccaatcaataaaggaagtcctgtccataaactatttgaatgcctcccttcttatttcttatagacacaaaatgatcattgccctcattcattaaattagccttgttgggttgtttgctcgctcttgtttgttttgctaagattactattctgggccaggcgcggtggctcacacctgtaatcccagcactttgggaggccaagccaggtggatcatgaggtcaggagatcgagaccatcctggccaacatggcgaaacccaatctctactaaaaatacaaaaaattagcctggcctggtggcagacgcctataatcccagctactcagggggctgaagcaggagaattgcttgaacccaggaggtggaggttgcactgaactgagattgcaccattgcactccagcctgggtgacagagcaagactccatctcgaggggaaaaaaaaaaaagattactattctgaccaactggttaccttctgtcattttctaggactgtggacggcaagacatttaggagctctattaaggagaaaactgtgggccgagctctttatgcacaggccagagcaaaaggcaagacggctggcttggtgaggtaaggcctgagtgagcaaggcttgcccttgcctctcaatgacggtttcctctcctacttccttcccacagcagcaaagcagcctctggaaaggcacagcacctgagccaatggcaacctcctcagagccagatgttagaattaggcactgcagtttctattcgcctaaaggtccctcttcaaccaatgggttttgggtgatcccacgctggttgtgcttacatcactgtcttgcaggtagatggatgttctgtaaataaacactgctttttctaaagagtgaagagagaaactacagaaatattggtgatcttgtgatcttgttacgaaacttaacatataagcagaaggaaaagtttgaaatttgccttaatgatttattctgactacttgtagggataaggggttttttttaattgtagttgttgttgttgttgtttgagatgaggtcttaattttttgcccaggctggaatgcagtggtttgatcacggctcactacaacctcgaactcctggccccaagcgggaatgcctcagcctcccaagtagctgggacttggggtgcaccaccatgcctgacgaatttttttagtttttgtagagataaggccttgctttgttgtctaggctggcctcaagcgatcctcccatgtcagcctcccaaagtactgggattacgggctgaaaccaccatgctgggctgcgatagggtcttcttaagcatcagttacttcacttaggctttgtttattttttccccttataatctaagtaagacctgggaatgccaagccaccctcaaaaagtagcttctcttcaaagggaaaaaatcttcaaagggatgttcaccttctcactccttgcactgcacactcactattttttttttttttttttttttttgagacggaatctcgctctgtcgcccaggctggagtgcagtggtgcgatctcggctcactgcaagctccgccccccgggttcacgccattctcctgcctcagcctccagagtagctgggactacaggcacccatcaccatgcccggctaattttttgtatttttcagtagagacggggtttcaccgtgttggccaggatggtctcgatctcctgacctcgtgatccgcccgcctcggcctcccaaactgctgggattacaggcgtgagccactgtgcctggcccacgctcactattaggccaaatgctgccgtgtttctttcctcctctcctcttctcttacatccccaaactcacctgtagttgaagttcttttcctttcattcatgcatttgttcattcaacaaaaatgcatcaaatgcaagctctgtaccagttctgtcagagacagcagcaacacaaaagcggacaccgtcagcctcatgcaggagacagacaaggaacctgtgacaacaatatctgcagtgggcaagggctaatacggaagagagggtacacaaaaaacactatgggagttccgagtgccgagtgtgtcatcctgtctgggggtccaggaaatccccacagaggactgatgtgtcagctgagcccaagtagattacagctggccttcgtattcatgggtttcacattctcagattcaaccaactgtggatgaaacctgtggatacggagggtccactgcaccatactgttttataacagtgacttgggcatcgccggattttggtatacttggggaatcctggaaccaaaccccagaggatacagagcaccaactgtagtaaaattcagccaggtagagaatggagagaagaagctccaagcagaggaaatgcctctagccttgctgcaggtgaatcagtccttttatctttaagaatcattttgccagccaggcgtggtggctcacgcctgtaatcccagcactttaggaggtcgaggcaggcagatcatgaggtcaggagaccgagaccatcctggccaacatggtgaaaccccgtctctactaaaattacgtaaattagctgggcgtggtggcgtgtgcctgtaatcccagctactcaggaggctgaggcaggggaattgcttgaaccagggagttggaggttgcagtgagtcgacattgtgccactgcattccagcctggtgacagagcaagattccttctcaaaaaaaaaaaaatcattttgccatctttgtccatcattttgaccacatcacccattcatttatttgtttatccatcacacaaatacttacttctaccagaaactcttctaggcactggagatacggcagggaacgcagagctcccatcctagtgcaccctcaggtaaacacggtgtctcactgcaggctctgtctcaaagctttgcacgaggccatgctcatctttttcttcaattatttgatatcgcaagctgactatccacaacaactccccaatcccttaggctgattgtgcaacatctcaccttgcttacttatttatttcttttcttttgaaatgaaatttcactctatcaccctggatagagtgaagtgcagtggcgtgatctcgctcactgcaacatccacctcccaggtctaagcaattttcctgcctcagcctcccaagcagctgggattataggcacccaccaccacacctggctaatttttgtatttttaggagagacagggctcactacaacctccacctcccaggtctaagcaattttcctgcctcagcctccggagcagctgggattataggcacccaccaccacgcccggctaatttttgtatttttaggagagacagggctcactgcaacctccacctcccaggtctaagcaattctcccctctcagcctcctgagtagctaggattacaggcactcaccaccacacccggctaatttttgcgtttttagtagagacaggatttcaccatgttggccaggctgttaactcctgacctcaagtgacccacccacctcagcctcccaaagtgctaggattacaggcatgagcctctgtgcccagtgtatttacttatttcatttaaaaaatcattccctgtttatcctaacgctggaatcaccagcactgataattctgctgttttctctttaaaccataaacacctcaagatcaatgatcacattgaactcagtatgtatgtgactaaaataaggccttatgatagaaaaacatactcaggccaggtgcagtggctcagactataatcccagcactttcagaagtggaggcgggtggatcatctgaggtcaggagtttgagatcagcctggtcaacatggcgaaaccctgactctactaaaaatacaaaaattagctgggcatggtggcgcatgcctgtagtcccagctactcgggatgctgaggtaggagaatagcttgagccctggaggcggaggttgcagtgagctgagatcacaccactgcactacagcctgggcagcagagcgagaccccagctcaaaaaaaaaaaaaaaaaaaagagaaacatactcaatttgagcaataataaagtttttctttctgaagaccttcagaaatatcaagaactcctatagtgagcctcaaatgcagtatgggaagagtgttatctttgaaccacccaaccttgggtgtgagttctgatcccacagtggactggccatggggtcttgagcaggtcctctacaagcctattttttttttttttttgagacagagtttcattcttgttacccagactggagtgcaatggcgtgatctcggctcaacgcaacctctgcctcctgggtcctggttcaagcatttctcctgcctcagcctcctgagtagctgggattacaggaacacaccaccatgcccagctaatttttgtatttttagtagagacggggtttcaccatgttggccaggctggtctcgaactcctgacctcgtgatccgcctgcctcggcctcccaaagtgctgggattacaggcatgaaccaccacacccagcccaagcctaatttttttatcatctgaaaagtcagggtaatgatctccatattgcagagcagctatatcagcaatgatagatgtcaaattcctggcccaggataggggccaatccctggtagttttttgcagacaacactcaagtcagtaagaagctctgggagctggagatcgggtaggagaggagactgaagctcttgttgggattcaactgatctagaagctgcacttatctctagtgtacctactgttcactttcatgaactactgagcagaacggacggtccaggaaattctacatgccctctgcctagattctgggtcttgctgctcaatcatgtatctgttgacttttgttgggggctttcacctttaggagcagcgctcttgatatggaaaacttcagaacggaagtaaatgtcctcccaggagcaaaggtgcagttcgaacttcactaccaggaggtgaagtggaggaagctgggctcctatgagcacaggatctatctgcaacctggacggctggccaaacacttagaggtaagcctggatctgtagggtgggcagtgacactgtccttttatagtctctgaccctgatttatactttctgcttgtcactagcacttgtggtgttggatgccactcaactctacaagacagtgggatgtattgaaaagatggtgggtttggagtcagccacaccacttccttatggctctcggtctccttagcagccgtattatggtggtttctgaggtctgctataacaagttacagcaaacgccacagcttaacacaacagaaattgattctctcatggaagtctgaagtcaaggtgtctgcagagctgcactctctctctctggaggctccaggggagagcccgttccttgcttctcctgctgtctggcagctgccagccttccttgacttgtggccttgtagtcagatcactccaatctcttcttccacggtcgcatcctctcctcctccgagcatcttaaatgcccctctgcctttctctcacaagaacacctattagatttggggtccaccaggtagtacaggatgatctcaactcaagatccttaattgcatctgcaaggactctttttccagataaatctacattcacaggttccagaggttgggcgcatctttagggggggaggccaccattcaacccaagacactaatcttcaaggaccagctatcctgagtcttcgctgtctcatctatgaaaagagtactgtaacagacttttgtttctcagttattttttttttaacttttaagttcaggggcatatgtgcaggtttgttacacaggtaaattccatgtcacaggggttgggtgtacagatgatttcaccacccaggtaatgagcatagtacctgataggtagttttccgatcctttctctcctccctccctcaccctcgagtaggccctggtgtcaactgttcctttctttgtgtccatgtgtactcaatgtttagctcctgcttagaagtgagaatgtgcagtacttggtttcctgttcctgtaatatgtggccaatgacaggagcttgatgaaggttaagtggattgtcttccctgccaccccagccatcatcaccgcaggggagcagtgcctcggtcatccactgcattactatccatctgaactcacctctgctgtcatcttcatctcttgctataaagactaaactgctcttttctttgctcaaatctttgtgacatcctatgactgtttagtgtaagaggcagagctaggcaagaggaaacctaagagagtacagaggccaacatgcccctcccccggcagatgggagagtaaagcagacaggttgtgaattgcccggagacacgggagatgaaagggaatgaattaatcacgatgaaactttaattcccatttgaaaagctgctcgtgggatcaataatgcccactgtttggcatcagttcactatcagagtctatgctgttgagttcttttctgggccactcctagcacataccgtgcttttgcgtgaattgaaaaaagatgcccgtccttcaggcaaatgcagcgccatccagggcacgtgacttggccaagatgctctgtacaattaagtgtgttgttggacatttttccactactgatgatggatgagtgtcagtaacccacattctcttcctcaatgccatgaatcccgtggtaaataatttgaagcaatggttagatgtgattagcatctaagcctaggaggagacaatcactgagactgttgataataacaatattaataaaaactgagtgacagcctgggcagcacagcgatacctcacctctactgaaaataaataaataaattagccaggcatggtggtgctcccctgtagtcccacccacttgggaggctgaggcaggaggataacttgagcctaaaaaatcgaggctgcagttagctatgatcatgccactgcactccaggctggatggcaaaatgagaccctgtctcaaaaaaaaaaaaaaaaaaaaaaagaaagaaagaaaagaaaaaatagcagctaagtaactcagaaacagaaaatcaaataccacaggttctcacttataagagagagctgaataatgtgtacacggggacatagggtggggaatgatagacattggagactcgaaagtgtgggagggtgggagtggggagacttgggagaagtgtgggagggtgggagtggggagacttgggagaagtgtgggagggtgggagtggggagacttgggagaagtgtgggagggtgggagtggggagacttgggagaagtgtgggagggtgggagtggggagacttgggagaagtgtgggagggtgggagtggggagacttgggagaagtgtgggagggtgggagtggggtgagggatgagaaattactcaacgggtacaaggtacattacttgggtggtagttgcactaaaagcctgggcttcatccctgtgcaatatattcatgtaaccaaactgcatttgtactccttaaatttatacagatttttcaaaataattacacaaaaatataaacaaacaaatcatagaattaaatttaaaaaagaaaaaaatggcagctatgactgtggtttggtcaagaatcaccaaaggggatttccctagatgaggtctgttcaaagcaagaagacagagaagaaataaaacaacccaagatttggggaaaatggtctacttttgacaggtctacagagtagatgcagtgctatttaacaatgagggaaaaagaagaaggaattctttttttccctaacaatgcaaatgctcttataaataaaaagactcgaatagaatgaggaagggagtcgactcctgggggagtgaggcagcagaaggagagctctgagtcgacagaagggggttaagcctccgtggtgagatgaatcccatcgcaggaacttgcagatcctgcaggagagatcgtggagtcgtgcccgggaaacctgcggaggagaaaagcatcagaggacttatttgtaattttacttcttgcttaaaaagactttaaagacttttaatgctttgggtaattttctcttgcatctctaggtagatgtgtgggttatcgaaccacagggactgagatttcttcatgttcccgacacatttgaaggccatttcgatggtgttccggtcatttctaaaggacaacagaaggtaccctgagccctgtgtgttgccaggcattcacagggcctctggattgtgggttctgttctccttctgtgctctggagaagagaaaagcaggctggtgttgaggacactgttgaagaaatggggatccccaagtagagcctagggcctccccaggatacacagaacaacactcccagtgctttccttccattttgaccagagattgtccctttttgagtctcatttccccgtcagtcacctgcttaaccagtagctaaaggacagctttcacatcctatatggcagattttcattcattaaccatagcaagacatgttcagctctctgcctcaatgaccagcgataaccaactatgactcctgtaaggagaaactcctctaagagcattaaaacatttcacaaactctttccaaagcacatagtcagcccttctacaggggatgaaggaaattcttcggctttcttctaaaaaggtctgaaaccttgcaaacagcatggcaggctagagatgctccctgcaaaagccctggcatgtccttcccatcagtaatgggtccaccgatatcgcggggattcagaacgtccattgggcagctcctcttccctgtgtgctggagaaggggcagcgccaagcactgggaaggggctagaggcagaggctctgatgtcaccgttctttctaggcgcacgtctccttcaagcccacggtagcacagcagagaatatgccctaactgccgggagactgcggtagatggggaactggtggtgctgtatgacgtgaaaagagaagagaaggctggtgaactggaggtgagtgcacaccggctctggttctactgccaagctcgtgccaaagagctgctcctttttgaacaaactcccaggcctatgggtggtttctagctgccagggcaagtgtttctagctgcagagaagggactaaaatcatattctttgaatataccgctaagcattatcttttatgtattaaaaactaaatgaatagggtctcatgctcttgtcccaggagggcattcctgggcctcatgtgaagaacaaaggaataattacagaacaggaattttaaataggctcccaaggccctttgcaattagacaatcaaagaaagcacagagattacggggtgaggaggaaggcgcatccacagcctagaaagatcaagagccagcggtgaatttcaaggccaaggtttatcatgaagtttcttgaaaagtttcctttccccttcagtcatgtcccagacgtgtgtcttcctttctttgtactaaggtgaggactcttagaacgtacgcaaactccaagagtctctctagggacagcaagcggagcacacaccctgtacctggatgctgtagtttcctggaaagaggcagccaaagggcagaggaaagagaattaggtgagccagtcatcaagcctgcagcagaagacaaagaggatggtcaggagtccagctggggcagcctctcattaacttcaagaaaaatccaaattttctaaagtggcccatacacgtccttcgtgatctgtcttgctgattctccaactagttccctgaattcttggattctacggccccatcttgctgaaccacatatggagccccaaatatgccatgttttctcatctctggggctgcgctgtctggaactctcttccccattccccactatctcaacctggcccagctctcaagagagcttctgagtctgagctcatccttaggtcccagtggagatgctgcttcctagagaaccgtcccctgggtgcgcgttagatgcacacggggctcttgccgagccctttacttcctaatcatggtgttgaacacaccgcgctgcacattgcctccacttacccttatcctctgctggctgggagcctcctgacgggaggtgctctgcctgattcaccgctggttagcagggcgcctggaacaggggctctctgtaaagactgagtgatgtggagtggagtggagtggagtgaagtggcgtggagtggagtggcgtgaagtcgggtggagtggagtggcgtgcagtggagtggggtgaagtgaagtggcatggagtggagtggagcagcgtggcgtggagtggagtagagtggagtggcgtggtgtggtgtggagcggagtgccctggcatggcgtggagtggcgtggcgtggagtggtgtgacgtggagtggagtggcatggtgtggagaggagtcaagtggagtggagcggtgtggagtgaagcagcgtggagtggagtggagcggaatgttctgctaggaaggtcttgaccctcagaggagaggaggtgggggagcaggcaggaaaatgtggaggcaaatgcacatcaagctccgcctcctcctccctgtagacccctctcttctctgagtccccaggtccccatcttcctaccttctaaacacgaatcatgatttgactcacaaataccttctatttttcaggtgtttaatggatattttgtccacttctttgctcctgacaacctggacccaattcccaaaaacatcctctttgtcatcgatgtgagtggctccatgtggggagttaaaatgaaacaagtaagtacccccttgtttgcagtggttggggggattccctatcttctttgatcccctcctaaaaatgcaatcattctatccctcctccctgcttagggctgaagctcagggactgtggttacagactgccggtgtcaactcttcctaaaattttgctattattgcatttcacaggacatacacctccgtcttctaatcattcctctagtgtaaaattcccttccttctcttcttcctctttcctgtttcctcttccttctctttctcttttccactctctatccaatatttccttgaaaaactgtctcaaaactcacctctttgaaaaacagaatctctatataacctcttctttcaaggatcagtcacattctttttgctcttccacatgttttattataatatcttgtcattgtccacatatgactattgattcaatatatacatattatttctaattatatggtaattgcttgagagcagctatccatcttatgttttccagctcagagctcaatataggcttacttagtgataagtgagatgtacagatgcaatactaaagaccaaacaaggaaatgatttaacttacccatcaatccatccatccattcaaccaagttgaacaaccaactaaccagtcatagggcaactatttttgaccacccaagagttcactactaccctaagatctgtaaggaacctaaaagaagtccctgtcagccaggcacagtggctcacgcctgtaatcccagtactttgggaggccaaggcaggtggatcacctgaggttgggagtttgagaccagcctgaccaacatggagaaaccctgtctctactaaaaatacaaaattagccaggcgtggtggtgcatgcctgtaatcccagctactcgggaggctgaggcaggagaattgcttgaacccaggaagcgggagttgcagcgagcagagatcgcgccattgcactccagcctgggcaacaagagcgaaactccatctcaaaaaaaaaaaaaaaaagaagaggaagaagacgaagacgaagaagaggaaaaagaagaccctgtctttcacagaccctgcctgcctgggtctgtactcccaggcagggtttctcagcagtgggactattgatattttggatggggtcattccttgttgtaggagggctgtctggtgcattgcaggatacttagcagcatggtctatggtctatttgctaaattttggtagcacaacctcccctgcatcataacaatcaaatataacgtcagacattgccaaatgtccgctggggggaataattgcctctggttgagaaacattgctctaatacaacagtttattcactgcttccttccttccatcactcattcatttaacaaatatttacgaagcacctactatgtgtcatacacttagttcatctatgagcaaaacagacccaaagcataaaaacagaaaccaaacaaaaaacagaaaaaaaacggatgcctaccctctgtgtgcttatgaaacttacatctgagggataggggacagagaataaacaatacacatgcaagtacaaatgtacaagtacgttcaatggcagcattttgataaaagtttttttaaaaaataaaagaagcatatgttaaaaaccaagagtggcaattgcaggggtatgcaattttaaataggcttgtcatctaaataggtggtttcctggagaagacctctgaggagaccctgagaaggtgaagggagagttgtgcagatatctaagggaattaaatgcaatgaacagctcatgcaacagttctaagtcgaaagtgtgcaaagaacagagagagatgccagtagagaggggcagtgggagatgagatctgagaagtgagaggcaaggtggctcatggaacacctgtgcagtcatgatcagagctggattctggaatctgttttgaaggtagagtaaacagtatatcctgaagggctagctgtgaggcaagggaagaaaagagaagtgaaagatgccccaggacttagcctgagtgactagaaggatgaagtggccatccatgagttgacaaagacagaaatgtaatcagacattgcagggaatgtcccagtttggttttggatgcaaagtctgagatttctattaagtacccacgttggccatggaagcgtggtgttcaaaagtgagatgtggagacacacagttaggactccccagcatatagaaggtactgtcagcattgggactaggtgagaatgccgaggagtagatggacaagggagccaagatcagacaacagagcattccaatattgggaatttgggaagaagaggataattggtgatagagactaataaaaacaattagtaagtgggggagaaaaatcaagagagaatgaggccctggaagacaattgaggaatttgtgttcaggagggagatgagagcacttgccggtgcatgagaaatgaagatggacctttggatttagtgacattagcatcattggtgaccttgacaagggcagtttcagtagagtgacagggatgaaaacccgaaaggattgggcttatgagagaataggaagagaagatttggagacagtgtgtttagacaattcctcaaggaattttattgcagaagaaagctgagaaatgaagaaagtggatgcacatgaggtttgtagaagggtgagaaataacatgtttttgttgatggaaatgtaccaatagaatagggaaattgaagaggcaaaggacaattgctggagccatgatctttagtcaaagagagggaatgaaatagttcatgaatagatgggtttgcattaggtagaaatactgctagttgttctttattatcaggtaggaaagaaaaatgtatgggtacaaatattgatggttgggattttatggtagtgggagtctgtgggaatgttcttctgtctgctgcagtttctcagtggagttggaatcaaaatcatcacacgtaagctagagaaagagggtgatggtggtggtttaaagagaaagatgaggaaatagtttaagagactgggtgagtagatggacttgagaaatgtattttattttcaggcatcataaaggtggcactcgaagtttgtgatccttaacataaagactagtcaaactggttgtgcatagcaaaatagatagtaaaattatcaaaaagccaacagtacatgcccagaataaataaggggcaggtctgcattgactgaggtgggctcaagaggttttctggaagaagtttagcttgagaagaacttgaaagatgaccaggatcaatgattggtcttcctagttcctctgaggctcagattttctgtaatgggacctgtctttattctctattgaaatagactgtggaagcaatgaagaccatattggatgacctcagagcagaagaccatttctctgtgattgatttcaaccagaacattcgaacttggagaaatgatttaatttcagctacaaaaacacaggttgcagatgccaagaggtatattgagaaaatccagcccagtggaggtgagtgtgttgggctaaatcccaaggagacacttcctctgggttcaaatcatgattcacttaagaagcattattcccatcacagtggtctttccccagcattcgagggcctatcttaaataatacatttattggtaatggatgaatgctaagtttgtagtgaaagtagaatttgtaatacagcccacataagctttgaaccgttttaatgtctctcagaaaaaggttcagtgacactggccttctttattgcctgcataaagcataaaatgttactatcttcagagtatcttggcaaggctgatttggatactttaatctggtgtttaacaagctaacagtctgtgctttgaaagggctagttcatctctaaggggatagtttatttcaaagtgaatatttcactgcactgggggaccaccagcttgagcacagtttgtgtcactcagaaagcaatgaaatgattttggcatggaataagtgatggataagtgatcagccgacatatgagtctgaatccagaatgggattttctgcgtgtggcgagaacgcatacccaacgtttcattatgctacttcaacaggcacaaacatcaacgaagcactcctacgggcaatcttcattttgaatgaagccaataacttgggactgttagaccccaactccgtctcgctgatcattttggtttctgatggagatccaacagtgggcaagtgtcacttcaaccttctcacgacaaacactttcactgttgtttcttggaatggtggtttgcctaaaaggggaactctaatggcatttgcctgagtttctagaacattttaaacccatgcttcctaaaggaggtcttctgatcctgcagccctcaccccttaagctactgctcagacactttcagcaagggcgctcttgaatgcctcagttccacctccacaatatgcagaaatctgagtctgaattttaatagtatgttgtgaggattgctgatgcattctagggaaatgcatctatttcctcaacttgaggtatgtgaagatggtgtatgggggtggtgaatgatgagtattgatcccagatctcccagcagtacctttggaggccacagtagcatattccctattattctccacacttctcccggttgcacctggagaaatgactgctctctgacacaaccttgaagttaaacatttttctttctacaaaatgggcagcaacatctccctacttctattatttatttttatttttgttacattagtttattttatttatttttgaagacagggtcttgctctgtcacccaggagggagtgcagtggagcacacacagctcactgcagcctcaacctcccatgctcaagtgatcctcctacctcagcctcctgagtagctgggactacaggtgtgcaccaccacactcagctaatttcttttttttctttctttttttttttggagagacgaagtctcactatgttgctcaggctgatctcaaaatcctgggctcaagcagtcctcccacctcggactcccaaaatgttgagattacaggtgtgagccactgtgccaagctatctttgttttacttgtgtctttattctggccactgtaagtaatagcgaatgccagattgtgttgcctgagtgtgctgtcgtacagactaggaccgagtctaacacgtcctgacacagccaagcagaatgaaaatgcacgaggcaaaaacaatggcagtcagagctttagaaagccagagagcaaccatcttattaataacgagactagaatgagccagtgttatgtatttgttgtagagccaatgttttctccctcagatcagattattttcaaaattcaagttttgaatgaaatcataaggtggaaaaggaaatatagtttaaaatattaaacttgccaggcatggtggctcacacctgtaatcccagcactttgggaggctgaggtgggtggatcacctgaggtcaggaattcaagaccagcctggccaacatggtgaaaccccatctctactaaaaatacaaaattagcctgacagggcggcgtgtgcctgtaatcccagctattcgggaggctgagacaggagaatcccttgaacccaggaggcggaggttgcagtgagctgagatcgtgccactgcactccagcctgggcaacaaagtgagactctgtctcaaaaaaaaaaacaaaattaaaccataatttggtttaatcatggtttctcactcctgtttctcaaccattcagttcctgtccctggaatcagtcactggttaccagtttcttgtgtatctttccacaaatagtttatgcatgcctgtatactatatatacatgtttgcacacatgtatgtgtatatgcatacatacacatacatacatttatacatgcatgcatgcaaatgcatcctaggtaccctgatatttaccttgttttttttttctcctctaaacatgcccttgagattgtctggtatacatacataaggagtttccatgtcctttttaatagctgcatagtatctcacggtttaaatgtatcatcatctaaccaagcgccctcattggtgcatatttatgttgtttccaatatgttgctaattcccaaataatgttgctatgcaacacaacccacacttcatttcaacatgtacgagtgcatctctaagaaaaactagaaattgagttactgggtcaaaagggaaatgcagttttaatctggacacactttactaaactgccctccctggattttccagaaaatttatgatattgcttcttcattcctttcctttcggacatcaccaactttaggcgaactaaaactgtcaaaaattcagaaaaacgttaaggagaacatccaagacaatatctccttgttcagtttgggcatgggatttgatgtggactatgattttttgaagagactgtccaatgaaaaccatggaattgcacaaaggatttatggaaaccaggacacgtcttcccagcttaaggtaacattttcttctgttctttttttattcttcactggaaatcatttaactacccatatctgatgcaggtatgatgcataactgaacttaactcaaaatggtcatgatctcagccatatttggttgcaaggatcagggaagtgcccagttcctttctcacatgtttccccccaccctcatatttctgcagtaacagtgaggtatgaggcagatgggtgttgggaacagctgtcctaccccctgaacaaaaaggccttctgagcgtcatcaaagctccttgtagctctcctgccccaccagcaattggtcttcttatcatcatggccaaccgttttctctttaacgtgcattggcatcttggtatcaatttttcacagtgtaaattttcttaagtattaagatacaggctgagtgtggtggctcatgcctgtaatcccagctctttggaggccaaggtgggaggatcactcgagcccagaggtttaaggccagcttgggcaacatagtgagatccatctgttcaacagataatttttttaattaaaatacatatattgaaaagacacaaactacttgtttgttttgattaaatagatgagaaaatgatgtagggaaagaacatgtttttccctgctctttgtcagtaccaggcatcgtatttaaatttgggaacaagtaagagataagattctgatttggggactattaacccagctgacttttgtaaaaatttaattattactattattttttgagacagagtcttgctttgtcacccaggctgggtgacaagtacgttcaatggcagtgcaatggtgtggtgcagtggttcaggagtgcagtgctgcgatctcggctcactgcaacctccgcctcctgggttcaggcgattctcgcacctcagtctcctgagtagccaggattacaggcatgtgccaccaggcccggctaatttttgtatttttagaagagacagggtttaccatgttggcgaggctggtctcaaactcctgaactcaggtgatccgcctgccttggcctcccaaagtgctgggattacaggtcaagccaccatgcccgacctcctgctgacttttatcataagtttgtccaagagtttttcacgctgaccgtaacagaaagggaaaaaaatgccaggctcttaaaccaaaggtaatgttctcaacaagtctttgtcttctctctgtttttaatctgataattacgagcattttcccttgtcccaaacgtcctgtgtgaataaattaagaggtatctgctgattctttgaagaatctcagagtaaaatgttttagatcagctgggcgtaatccctgtaatcccagcactttgggaggcccaggcaggcagatcacaagacagaagttcaagaccagcctggccaagatggtgaaaacccgtctctactaaaaatacaaaaattagccgggcttggtggcgggtgcccgtaatcccagctacttgtggggctgaggtgggataattgcttgaacccaggagccggagattgcagtgagacgagatcccaccactgcactccagcctgggcaacagagtgagacatcgtctcaaaataaataaataaataaaataaaatgctttagatctacaaagcagtaggaacataatttctctctctctctctgtgaattgtagaaattctacaaccaggtctccactccattgctccggaatgttcagttcaactatccccatacatcagtcacggacgtcactcaaaacaatttccataactactttggaggctcagagattgtggtggcaggaaaatttgaccctgctaaattggatcaaatagagagcgttatcacggcgacttcggtacttccacttatccatttattctatctactaactgaccccctagatacagtccctcttgaatgtcagctctgcctgcctggaatcatgggtgtagaacagaagcaatcagtgatggagaaggcatgagaatatctctgccatcttcccagctattccataaatcctgaccttttcacccaagcccaatcccaagcacaggaatgcatttccttcctccgtaggctttgccttccatttcttttttattcccattcattcgcagcaggtactaaaaatgtgaatcaatgaactataattctgttacccagtgtctctcaactgaaccttccatcatctaggctaacacgcagttagtcttggagaccctggcccagatggacgacttgcaggattttctatcgaaagacaagcatgcagatcccgatttcaccaggaaactgtgggcctatctaaccatcaaccaactgctagctgaacggtaagaagagaagagtacccacaccacgagatctgcaaaactgaaatgtccaccgtgaatatatgaagtcatacacaaaaagagtttggaagcaagaaagacagcacattagcacaggcttggattattaccttccactagttctgaacacttcagagaaagctgggttcactctttttcttctttattgaggtataacatacagtaaagtatgcaaaatgcattaattttttaatttttattttatttatttatttttattttttttgaggcagagtctcgctctgtctcccaggctggagtgcagtgacgccatctcagctcactgcaagctccgcctcccgggttcacaccattctcctgcctcagcctcctgagtagctgggattactggtgcccaccaccacgcccagctaatttttttgtattttagtagagacggggtttcaccatgttagccaggatggtctcggtctcctgacctcgtgatccacccgagtgggcctcccaaagtactgggattacaggcatgagccaccgcacccggccaaaatgcattaattttaagtgcaccattcaatggatttttatatctatcatccgtgtaatcaccacccagatccagatgtaggttcccttgttctccctcaacacccacccccctcctccactgtaaccactctttcaatgtctgtgatcatcagttttgcctgatcctaaatttcacataatcatgcaatctgtattcctctgttcctggcttctttcactcaatatgatgttggtgagattcatccatgttgcttcatgtatcaggcatgtatttgcatttactgtctcgatctcctgacctcatgacccgcctgcctcggcttcctaatgtgctgggattacaggcatgagccactgcacccagccctgcatttactcttgaaaatggcttcttgtccaaagagaaattgatgattattaacgattatggtgttccctaaggaagggctcccctatgctcatctatgtcccctctggttgcttcatgtatcagtaatttatttgcatttactcttgaaaacggcttcttgtccaaagagaatttaatgattatgtgattatgatgttccctaaggaagggctcccccatgctcatccatggcccctctgacttctcagctgagctgcatctcaactctccaacatgaaaactatatccccagagcaatggatggttgaccacctgcatcaaaattacacagaggtgtttgataaaagttcccattcccaagcctcattctgtctataagacaggattctcaggaaggtggaacagggtctaaatgaggctgggaaaatgaaatgcagttgtatgactgaactcatagagaaaatccctgatgtcaataaggttagaagaaatacgcaaggctgtaaactatgactgtgaagtaaacgagaaatagctccctctctgacagaagcacactagatgtatttacaggtatatagcaaattgttgcagaagttaaatattgattttaaaacaattcctataaaaagatcagcagttgctaaaggttggggagtgggagatacgtgagtaggtggagcacagagcatttttatggcagtgaaaataccctatatgatactccaatggtggacacctgtcattatgcatttaaccaaacccatagaatgtacaacaccaagggtcagccacgttaactgtggactctgcgtgataatgatgtgtcagcttcttccattgtaacaaatgcaccactctgatgtgggatggatgttgatagtggggaaggccgtgtatatgggggaccgtgtgtatgcagtggagacatagaaaatcttgataccttctgcataattttactgtgaacctaaaactgctctaaagtataaagttttaaaaaaatgccttgggagccagatgcatggctcatgcctgtaatcccagcactttgggaggccaaggcgtgtggatcgcttgagtccaagagtttgagaccagcctgggcaacatggcaaaagcccatctctacaaaaaatacaagaattagtagggtgtggtggcatgtgcctgtagtctcagctactcaggaggctgagggaggaggatctcttgagcccaggaggttgaggctgcagagaaccgtgattgtgccactgcactccagcctgggcaacagggcgagaccttgtctcaaaaataataatgataataaataagtaaataaataatgccttgggacttagccagataaaatactcagcttctcgaagccagtgagttctgtttcccagttactttgcggctccgccccacccccaggttggaccccagcagtggtggggtgcagggtcagggagctgacttgcgctccccctccaatgcagccatgctccataacacctctacttcttgaatacagaagcctggctcctacagctgccgccaagagaagaattacaagatcgatcctgcagatgtctctagaccaccacattgtgactccgctgacctcgctggtgatcgagaacgaggctggggatgagcgcatgctggcggatgccccaccgcaggatccctcctgctgctcaggtcagggctgcacctgtggggacaagtggccaggcagctctcttgccccgggggtgggcgaagtcctagtgcctccgctctctcccaccccagcccacctcttgctcccagccctgggccctcctgtgcccaagctcttcctgccagctgggaggaggatggattattgctgtggtcgttgaccattttgctcacaagtttcccaaaggaacttttgaaaacctgcgtaccccttccaacatttttgacatcaatatttgaaattttttatcttagcctgggcaacatagcgagaccccatctctaaagaaaagttttttttcattagctgggtgtgatggtgggcacctgtaatctcacctgtttggaaagctgaggcaggaggatctctcgagcccaggaggaccactgcactcccgcctcctgggggtgccatcacatctcactgcaacctccaattcctggacaacaaatacaatttctatatgcaactaacataatcatagtattttataaatattgaccttttaaaataaaactgtcacatcactgttttctttttcttttcttttcttttcttttcttttttttttttttttgagacagagtcttgctctgtttaccaggctggagcacaatggcacgatctcagctccctgcaacctcagcctcccaggttcaagcaattctcctgcttcagcctcccaagtagctgggattacaggcatgtgccaccacgcccagctaattttttgtattttagtagagacggggttttaccatgttggccaggctggtctcgaactcctgacctcaggcgatccacttgccttggcctcccaaagtgctggggttacaggcgtgagccaccgtgcctgaccatatcactgttttcaatacatctaataaaacagaatacttaattggttactcactatcactcatttttaaaaaatacataagcaaatcctatattacaattactagaacctggccagtcatggtggctcatgcctataatcccagcactttgggaggctggagtgggttaattgcttgagcctatgaacatgagacgagcctggtcaacatagcaaaaccccatctttagaaaaaaatactaaaattagccagccatggtggcacatgcccatagtcccaaatactcaggaggctgaggcgggaggattgcttgagcctggaaggtgaaggttgcagtgagccaatcacaccactgcactccagcctgagtaacagaataagaccttgtctcgaaaaaaaattattggaagttttatattattcttttttctagttgaacttgtatttccactccacttgcccagcagaactatatcctattgtaatatatttttatgcttattttagtaatcacctcacttatctataagaaaaaaagtttatacattttaattttaattaagaatttaatttaaaaatcataaccataagattctgagtattcaaaattcccttctgaacctggtctgattaatattactactagtagccaagtgagcaaaataatataaatagattataaatttgtttacaaataagaagtaaaactggagtggaaataatctataatctcttactgggaaaaatgtgactgtttttcatgtattcatgggtaagtattatttacgaatggattgaaagagacaggattcggcatcaattctacttttaagagaacttgtatgggcagaagtcctgataaatattggttggtatagacaagtggatagaaatggcaagtgtctggttatattcagttactcgcttatctgaactctttcatattatatgccaaaacatgcatacagacctagcgtccaaaaaattttgtataatttatcagctgacaatgtgagcccttcttcaattttgttgaaagcaaagaattggaagccctgtggtttgtacaagcacttgctcccaatcattggaatcaggtttcttgccctacaccagtattccaatggatgttttgcttcctggaggactctgggggaggggagtagacaagaactggccttctgcttgtaaactaggagaaaaggctttctttaggaacgagtctgtgtctaaactgagactctagaaattgcctttcaaacagtccatgctctctgagtcctgcagaaagtatccaggcacccccgagggtgcacacacccagggctaggagacctcaggtttatacgtctctttcttttctctttcttggggactggttctaccgaaacatatatacatatatgatatatacacacacgtgtatatatctcatatatatatatatatatatacacgtgtatatatatatataacagataacgtataattataattatattatctgtaatatataattatatatattttgtattctatatattatatactatgtattctatataatatatattatgtattctatataatattatatattaaattctatattctatattatattctatattctatagaatattctatattatattctatattctatagaatattctatattatattctatattatattctatattttctatattatattctatataatattctatattatattctatataatattctatattatattctatataatattctatattatattctatataatattctatattatattctatataatattctatattatattctatataatattctatattatattctatatattatatattatattctatatattatatattatattctatatattatatattatattctatatattatatattatattctatatattatatattatattctatatattatatattatattctatatattatatattatattctatatattatatattatattctatatattatatattatattctatatattatatattatattctatatattatatattatattctatatattatatattatattctatatattatatattatattctatatattatatattatattctatatattatatattatattctatatattatatattatattctatatattatatattatattctataaaatattatatattatattctatataatattatatattatattctatataatattatatattatattctatataatattatatattatattctatataatattatatattatattctgggccttctcccagacttcgctccccggcctgcactggagtcacggggcccttccccggccctataaagcggttcctcccactgccacccttgctcaggttccagactccagagagaactgtatcacaggcctcctccctcagcaacatgacagagggagcccgagagaactctggaataaaaacagaggagaaaaacctaagctgacaatacctgggggtgcataaaacagattcttgacatggtgagcaatttccgtggaaacgtaaatctagaaactaacagatgcaggtttgtctacgcaggggccctgtattacggcagcaaagtggttccagattccaccccgtcttgggccaatccttcaccaacgcccgtgatctccatgctggcacaaggatctcaggtgctagagtccacgccacccccacatgtgatgagaggtaacgcttctacactgcttgcacgtcccagaactcagccgaccataatcctgggaagcattgtgtgcatgaggccaggtgcagcggctcacgcctgtaatcgcagcactttgggaggccaaggcaggcagatcacctgtttttctatagaaatacagcttattttgtttgtttttaatcatgtatttacagaatcctagttttgttcagtctttaaaaaaacctttctgcaaacagtttcagtgggaggtttgggtagtagctgtggtcatgccaggaaaatgtatttctttgtgagagttttggtggctgtggcttccttgtgtagtcgcagacttctttgccctccgttgtcaatttctttgcctttccattgacaacctctctggcatcttctcccacagcatgtgagacggggagctgccccggggaaatgggagggagagcgtctcctctcctgttcccagctccttgcgttgcagccttcacccacagagatcacagctgctggcagttagctagttcatctagaaaacctgtgtgcagcttttctttccttactttccttttgattagaaaaaagtaaatttcaacattcaaagacagagcacatccctctccctgaaggaaggtgcaaagtcccagcctgacttgagtgtttgaaatttagaagggtggctcctgttggtcctagaattgtgcggctttcttgactgcctggaatacagacctttccatcaggaaagcctcaaagctggttctccaggttgtatgcctagcacataccaaataccatgttgtagcagagaaaacttagcaaggactttgaatggacatttaatgttatttcaggcaaggcccatggctcacacttgtaatcccagcacttttggaggctcaggtgggagaggattgcttgaggccaggagtttgagaccagcaaaaaaaacaaaaacaaaaacaaaaaaacccttttcaaaaaattagccaggcatagtggtgcacctgtagtcccagctactcaagaggttgaggtgggaggtttgcctgagcccagaagttcaacgttgcagtgagctatcattgcgccactacattccagcctgggtgacagagggagaccctgtttcaaaaaataaagtagggaccgggcacggtggcttacgcctgtaatcccagcactttgggaggccgaggagggcagatcacttgaggtcaggagttcgaatccagcctggccaacagggggaaaccctgtctgtactgaaaatacaaaaattagccgggcatggtggcaggtgcctgtaatcccagctactcgggaggcttaggcaggagaattgcttgcacctgggaggcggaggttgtagtgagctgagatcatgccactgcactccagcctgggcgacagagcaagactctgtctcaaaataaaataggataagataaaacagggtgataaaatagtaacttcatctcacccttagggcttatctctaaaattattattttggggccacaagtaacttgctccttcacctccattgctggtagcactttgtacaacactcccgtctcctaccccagctccatagggagtcccacgaaccatgcagaagtctcagttaacagcggcaaacgtctgcagccatgcatgagtggggaatccgtgcgtaagttgatcatgctggaggagcagttgcttttactgtgcctttctgaccagcagtttctgagagccagacactaccatgacgcccagggagtgagctgcttaaactgtggctttgcaaaataaagcttttggagaaaattgttgagatcaagttaatttacttttaaatattcttcccatttaagactgtagtgcttcttccaagtttctcttctctgttgtatgatgtagtgaaaaggatgaggacttcaaagttagacagtcctggagacacatctgccccatgaccttgtccatacactgaaatctccctagggctcaagcagcccacctctaaaacggggatgataataccctccctgcagggtggatacaagtttctccttcctagtagaagctgttatcactgaccagtgttctgcccatgaacctcaggtgctaggaatctataacattagtcacggaggtccttgatctactttctgcctgatcaaaatgtcaagctgtgctgactcatttaaacatgatgcttcgtttctgttgtcttgaattatgtcaactcaatatggcagcacagattcactgttgcctatcagaaggtctgattggcgggatttgagctaattaaatggcaaaaccaatcgttgtctttaataaaagcaattttcttcgaacagaatatttcaaactaccatatttgtgtagaggaagaaagaggatatcataatgattgtttaaggttttttttttttttttttttttgagacagagtttcactctttttgcctaggctggagtgcaatggctcgatctcggctcactgcaacctctgcctcccgggttcaagcaattctcctgcctcaggctccagagtagctgggattactggtgcccgccaccacacccggctaattttttgtatttttagtagaggcggggtttcactatgctggccaggctggtctcgaatgcctgacctcgtgatccacccgcctcagcctcccaaagtgctgggattacaggcgtgagccaccgcacctggcctgttctgtgtttttacaatgccctgtagtgtctggctccaagaacaatcaactaaccatgtatttgtggactgcagagcatgaacctggaggtgtgaactgaacatttctggcctgagtgactgctttagccactgcacaagcttcctgtaactcctctgcaaacttttagtaacactgccaccaacaactttcctaaaatgagggtcaagtcacatttattctcagaaacctttaatagctgctcaacagaataaaggcccattcttggtgtttcagggtctctgtgatctctacttttagctctttttctctgcattcttcaagaacctgtcctctggtcgcattgagttattttctaaagaaatcataaactcttctacctccactccttcctcattctgtacactcagaataaaatctcttcctccttagccttttgtctttccccgctgtcctctgaccttaaagacagttcagaagccacctcctccattcagccttgctgtttgcctggggggcactaatcattttcatcttcattctcacagcattttacttgagccactattgcaccatgtacttcattctatcttacattcgtgattatgtctgccccttgcactaaagtattactttcttgaagttactgaccatgacttatgtttatagttaacaccaaacattgccaaatttagtgattgcacatagattttttttttccttcaccaagtatttgttgaatggttaaatgggaaagagcgggagagggagagtggggatgggggagcgggaggggaggggaagcaaggaaggattatctaaaataattaggttcaataacaaaggagtactttcttgggagtagcttgattcttcattgcttttggaattgaatcatattaatctgtatgtcaacaataatagtgtgtctcctttgttttcctgcattgtatatggctccttaaaaaatatatctccaggctgggtgaggcggctcacacctttaatcccaggactttgagaggctgagatgggtggatcacttgagttcaggagtttgacactagcctgggaaacaaagtgagaccccccatctctacaaaaaatacaaaacattagctagacatggtggcacatggatgttgccccagctactcaggaggctgagctgggaggatgacttgagccttggaggtcaaggctgcagtgagccatgattgcaacattgcactccagcctgggtgacagagggagatcctgtctcaaaaaacacccaactctatttttctgtctacacacatattcacacacgtgtatgtatgtttcttatatttgtgggtgcatatttgtgtgtatttcttattccttaagtctttcttattcattttttatctctagtatctagtctagtgcatacatttttagctacaaaataaatatccactatatttgtaaaataacatagggttctgaagaaggctccgtgacaaagggacaatggagtatgaaccactgggtccccaagacctggaggagtaccgagcatgtaggagaagcacaataaatatttgttctgattaaattaaagatgttcaggaatgacatagtgctcaaaatcatcttccttttaatgattttgtttacgttttctttgtatattttccagttgaaaatgacccacatttcatcatttatctaccaaaaagccaaaagaacatttgtttcaatattgactcagaacctggaaaaatcctcaacctggtttctgacccagaatcaggtaaaataaaaataaattatatttgcaccaattaggtcattgtcatgctttcctgtcactgcctgggatttctttctttctcagcttaatagaagttctatatatttcagtgatattagtgagaaattaaattataaatatattcttaactattttgaaccattatagttcaaaatatatactctgagtatgaacttgcagatcttgttgtgatataattaatttaaatatgagccaggaacggtggcttacacatgcaatcccagcactttgggaggccgaggtgggcggatcatctgaggtcaagagttcgagaccagcctggtcaaaatgatgaaaccccaccccccactactaaaaatacaaaaacaattacccaggcgtggtggtacacacctgtaatcccagctactcaggaggctgaggcaggagaattgcttgaacccgggaggtggaggttgcagtgagccaagatcacaccattgcgctccagcctgagtgacagagtaagactccgtctcaaaaacaacaacaaaaaatttaaatactatatgatagtcaattatttaaattttataaactgacaattaaattttataactgatataaaattattaaattaaattttattaaaatttataaatgttatattaacatgttataaaatgagaatcacaaagaagaaaatgttaatgtaaatcttgaagcaaaattataataattttccaatattgccaagtttttataaatttgaattatagtacccacacatgcaaaataaatggcacagaagagaaaacatcatttttttctttcctgtaggaattgtagtcaacggtcagcttgttggtgccaagaagcccaacaatggaaaactaagcacctattttggaaaactgggattttatttccaaagtgaagacataaaaatagaaatcagcactgagaccatcaccctgagccatggttctagcacattctccttgtcctggtccgacacggctcaagtcacgaatcagaggcaagtatgattccatctgaacttgggcctgtccgtgacacacgactgcataaataaatccaggcatcagtgacatcaacattgaaaaaaaatcatcattttaaatataaggaagttgaggttcagaaaaattgttctcactccctactctgttcctggcagtgggcactgtgtgtttttggtcaccgttgggtcccaggacctagtccagtgcctggcatcagtaaacactcactgtgtatgtgctaatcagtgaacaaatccaccagctgaaatccatactgactctatcgcagagtgagctccaaacgccatgattgtgtcctctgcgtagaagcttcccaatgagtttctgttaatccatcatttatctataaactgttgcaagcgcttagataactagcggaattgtctgggaggagtgaagagttcatattaggggtgagaagaatgactttctcaaaaggtctgttctggaatggtttaattcctcttggactttcacaccagggtgcagatctcagtgaagaaagaaaaagtggtaactatcaccctggataaagagatgtccttttctgttttacttcatcgtgtttggaagaagcatcccgtcaatgttgactttctgggaatctacataccccctacaaacaagttctcacctaaagcccacggactaataggtaaagtgtctattgaccatctgacaagggtggggccgctctaattctttagcagctttggttgacagtggttacaagttgaggacatggcaggtgtggactcatgagcacagaggactaacatagcagtgtggggtcgctcgggaatgtgacagccaggaccttttgccattccagacaaggttgtccagggccaggatttcagcatcacaaactgggcaagttaagagaagggacagatacattttaagttttatgttaaagatttttttctaactgaagcaagatgaacccatttaggaggtctgtgataacaagcagaacactctggacaaatgtccctagtattttaagaagggctcaaatataaagcctgtgacatcacaaacaaaactttttcctgtgatctgagctatactctcaggtgctcacctcattctcctgccatcagggtgctcgatttacttacaatccactagaccaacctcatgtataaaatgaccatgagctccaggcatggtggctcgtgcctgtaatcccagcactttaggaggcctgggcaggtggatttgcttgtggagttcaagggcagcctgggcaccccatctctaccaaaaaattagaaaataaaaataattagcagggtatggtggagcctgcctggagtcccagctactcaggaagctgaggtgggatctcttgagccccggaattggaggctgcagtgagctatgactgtgccactgtgctccagcctgggtgacagagggagactccatctcttaaattaattaattcattaatttatgagatggagtttctctcttgttgcccaggctggagcgcagtggcgcaatctcggctcaccgcaaccgctgcctccccggttcatgcgattctcttccctcagcctcccgagtagctgggattacaggcatgcaccaccacgcccagctaattttgtatttttagtagagatggggtttctccatgttggtcaggctggtctcaaactcccaacctcaggtgatctgcccacctcggcctcccaaagtgctgggattacaggtgtgagccaccacacccggccccaaatcttaaatttaaaaaaaaaaaaaaaaaaaaaaaaaaaaaaaaggctgtgagtagtggctcacacctgtaatcccagcactttgggaggctgaggtgggtggatcgcttgagtccaggagttcaagatcaacctgtgcaacacggtgaaaccctgtctctacaaaaaattagccaggcgtagtggctcacgcctgtggtcccagctacttgggaggctgaggtgggaagaacacttgagcccaggaggtggaggttgcagtgagccgagatagcaccactgcactccagcctgggcaacagagggagatcctgcctcaaattaaaaaaataaaaataaaaaaaagatggtgagcagcacaaatgtgctcccaggaaggaccctccctcccatcaccactcctttttcctctcagcttgtctttccaccctagaaatcctggagggaggaccgaaaggtagcatggagtcaataatgagcctctttttatttaactatgattacatgtcaatcaatgtctgattctgttttgctaggccagttcatgcaggaaccaaagatacacatcttcaatgagagaccaggaaaggaccctgagaagccagaggccagcatggaagtgaaggggcagaagctgatcatcaccaggtaggcctcgggcgtaaggacagtgacgaaaaggccttgtgttagaattagacccacacagcaaaatagaggagcaaagaagaagtgtcgtaggcactacctacatcacactaagcagttcattaggaatagacgcacacagcattcgcataaggacacttctgatatcccacgttaaatgcaaataatgactgggtatctagggtcatgcaatgccaagattaactaacctgttgttctcatcttcatactttagaagccctcacaagagcttcacaagttggataaccagacacgttgatcaaaggagagaatcataaaacacctattaccatagtgctgcagaatgaatgtagatttttacatcaggctagagttttccttttgcacagggatctctgactgctttttttgtagcttttcttacacaaaccacccccatatgcttcatctgaagtgagaacttagacgctcataacgcattctgagtgtaaaagtcttacaaatcttgatattttttcccagtcctttacagttgtctcacccatgccaaatttgataccgttttaaagcagcttacccctttttagagtttttacaaagcagccaactttgctttattagaaaggattcttcacgcccacaaatgtcattggctttgacatacttaattaaaccataacattgtaacataaaattgtagtcggaagtattgccacgaaagtagatttgtgaactgaaacaatggattcttagtgaatatgccattcaattagtatcagtttatgggaggaatgaggtaccgacgggaatcagtgagcatgtgtcacagaagcaatggtgagcacaaattattaatgttaatagtaagttatctgaagttggtagaagggcatttactgccaggcatggtggctcatgcctgtaatcccaatgctttgagaggccaatgtgggaggatcacctgagaccaggagttcaagaccagcctgggcaacatagtaagactccatctctacaaaaataaaaataaatataaaaataattatccaggtgtagtagattctgcctatagccccagctactcaggaggctgaggtgggaggatccgttgaacccaggagttcgaggatgaagtgacttatgattgtgcctctgcactccagcttgggtaacagagagagacctgtctcataaataaatacataatatataaataggccaggcgcagtggctcacgcctgtaatcccagcactttgcaaggcctgggtgggtggataacctgaggtcaggagttcaagaccaacttgccaacatgttgaaaccccccccatctctactaaaaatacaaaaattagccgggtgtggtggcgggcgcctgtattcccagctactcgggaggctgaggtaggataatcacttgaacccggaaggcagaggttgcagtgagcagagatagcaccactgcactccagcctgactccatctcataaaatatgtatatatatttatatatacatatataaataaatatatgtatacatatatatatatatttactataatgacaaaaagtaaatgctgggcctcgatttggtccactgcaagcacctcatggttcataactgaaactgagctgtcccgtgggctgggcacagtgatacttttaagtctcgttcacgcagtgtgaacgagatccttaacaaattgttggctactttgcccttcaagtggaggacatgaatctgctcagaaacagcaggtatcactcttaaacacagagaaagtgcagttaagaggtgccgccaatgcattctttttttttttttttttttttttttttttttttttttagtgacagagtcttgctctgtcgcccaggctggagtgcagtgacgtatcttgggctcactgcaacctccacctcctgggttcaagcaattctcttgcctcagcctcccaagtagctgggactacaggcgtacaccaccatgcccaggtaatttttcttttaatttttagtagagacagggtttcaccatgttggccaggctggtcttgaactcctggcctcaagtggtccgcccacctcagcctcccaaagcgctgagattacaggcgtgagccaccatgcctggctgctgactcattctttaagtgacctgtgaggtcagcctcaacactgtggagtcttgttcctgccttctttccattggctactgtttccctcgctggaaaagcccatataggtcaactctaagggttctttgagttctccaaggacgcttcgctgattctctgtgcttccaacaccaagccccagacttggtgtttctttttcacatgacttggggagcagcgataggtggggggcggcagatgtggtgacagaaggaacacgaagaacagcaaggaaaagagggagtcttgtgtctagaggtgctcagtctccccctaaccacatgccttgcttccttgcaggggcttacagaaagactacagaacggatctagtgtttggaacggacgttacctgctggtttgtgcacaacagtggaaaaggattcattgacgggcattacaaggattacttcgtgcctcagctctacagctttctcaaacggccttaaaggtttatagtttgggaaattatatatattaatatacatctttcccctgtcacttttgcagatattcttcggtttgaataattaaaatgaaccagatatcagggtggttaattaaaatgaaccagatatcagggtggtttataaagcctgtaaacacacctaagaaaataaacattttacaaatgagcttttaggattttgttgcatttttagatgccgaagtgtgtggatcaaggtggtgccgagacaagccagcgtctggaagagccttaaatttggtgtttactgtgatcatttattaatatcttttctttcttttttttgagacagggtctcgctctgttgcccaggttggagtgcagtggcgtgatcatggctcacttcagcctcaagctgggcacaagcaatccacccacttcaacctccctagcagctgggactacagtcgcatgtcactatgcctggctaatttttgttttttgcagagatgaggtctcactatggtgcccaggctggtctcaaactcctgggctcaagtgattctcccgcctcagccgtccaaagtgctgggattacaggtgtgagccaccatgcccagctgatcatttcactgctgttgagtctcaggtcctcaaccttgcagatcgcgtccatttttacactgctagttacatgggaagtacaattatgagagggttatatggtgagcatagaacaagaaatgggggttacttgatcttaggtgcttcgtagagatttatactaaagccctgttaccctctgtagagatttatactaaagcaaggatagccttgctatggtgcctgtgatagcccagtatttttagccaagattctcttcatagtgttggtccctgggtcccttttgagtttatgaggcctggattagccatagttctccaggaaaacagaacccataggagatttacaataaggattggctcatgtgattatggaggcttgtaaatccaaaatctgcagagtaggctgatggtacaggagaactagggaggagccagtgttccagctcaaaagccatcaggcaggaagagctgatgctgcagatgaagttcgaaggccgtacactagagaatcccccgactttgggaagtcagcatttttgttctattcaggcctttgactattagacgaggcccacccacacaagggagggtgatttgctttacttttttttttttcttgagatggggtctccctttgttgcccaggctggagcacagtggcacaatctcggctcactgcaacctccacctcccgggttcaagcgatcctcctgcctcagcctcccaagtagctgggattacaggcgtgagccaccatgcccagccctacttggagtttttgttgctcccaaattctgcacatatttaaaatcgctcaggatgttacctcagatggctaattatacacattgttaatgttgctaaatgaattctgaatcatagttccaaattctctggaagccctctgtgtctgtgaatcaagtttcacacaaatttaatataccttgaacacagcatcttttttagtactcctggtagaactgttatttcatttgcatttaaaccatttctgagtaataccacttacatgctaaatcttagactttatttcaaaataaagtagtaaattatgttctaacaaaagaccaatgacatttataagggagaataaaataagcaacaaatttaaagcgaaactaggttactttatgctgtctgcatttgtatagtggattttggtgctaagatgcaagtctgaaccagtgtaattctgtgctttgctgtgtttacaactttccttaaaaaatcaattcctaaaatgaacgtattttcaaaagtcaaattggtgaacttgcactttaaaaaagctttttaaaggcacatttttatgaatcttcctttccataatctggtaaaaatcatttttcattgtagaggcaaaactctttttttggacatatccaacccatatttgaaaaagcaagtgagctcctctaaacctaattgcaaaatcttaaggaaatctgattgtttctagaagctaaagattactggctgggtgtggtgcctcatgcctataatcccagcactctcggaggccaaggcaggagcatcactggaggccaggagttcaagaccagcctaagcaacacagtgagactcccatctctttatagaaataaataaaaataaagataaacttagtgctgaagaggtaaatagcactacctcttagttttcttcttctataagaagtgctcacctatgatacccttttgaaaaacctactgcatcttttccatttcctatttcaaaaatagaaaaatattaaatattagaatgctaatattcaacataaacttcaaaagtgagattttagcattaactctgttatttggttaaaatcttgaatttaaaacttctacctgcagatattaagtttagcttttagtattttatgtgtgcacagtggtcttaaaagtaacgatgtactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaaaaaaaagtaacgatgaaaatcttggggtgttaaaaaagaatagcttaaaacaaaatgagaagacaggccactgactgagagaaaatacttgcaaaagacacattcgataaagaacacaactgaaatatacaaacaactcttaaaattcaacaataagaaaatgagtaacccaattaaataatgggcaaaaaacctgaaagacatctcaccagagaagatatacaggtggcaaataagcccatgaaaagatgctccacatcatacttcatcaaagaaatgcaaattaaagcaatgacaagatcccactgtacagctattaagatggccaaaatccagaacactgacaacatcaaatgctgacggagatgcagagcagcaggaactctcattcactgctcgtttgaatacaaaatggtacagtcactctggaagacaggttggtagtttctcagaagactcctggcatatgatccagcaattgtgctctttggtcgttacgtaaataagttgaaaacgtctatccacaaaaaacctgcgcacagatgtttgtagcagctttactcataatttccaaaccttgtaagcaaccaagatatccttcagtaggtgagtgcataaactgtggtgcattcagacaatagaatatgcagtgctaaaatgaagtgcgctatcgagccacaaaaacctaaccaaaacaacatggaggaaccttacatgcatatgttctaccaggtgaaagaagccaatctgaaaaagctacaccctgtgtgactccaactatatgaccttcgatggagacaaaactagggagacagtaaaaagatcagcggtcagcagggatttggggggagacagggaacagacagaacacaggaaacttctagggcagtgaaactgttctgtgtgatactacagtggcagatgcatgtcattatacatttgtcaaaacccacagagactgctctaaaaagtaaagtctatgtttgaaataaagaaaaatagcttatgatacttcaaaaatcaaagtctaatatgagacctgttgttagttatctgcagtcattttgcttagcataaactctatcaagttctacagactcagagggaaaaaactactgtgaagtctataatcgtatttttatgcttcagatattttttattgaatttaacctcaagtatgctgcctcatttcattctgaaataatttcagaaagacgttggagaattaaatgtgggaggcagacatgaaacattttttctctgaagaaaaccaccaagttgattccaaacgtacatacttgggggaggcatatgtaatttgtctggttttactcatcactatttgttatcagggagaaccattctcctttttgaaattcttcagaccagattcttagtagtccaggctcaacttcttggcttcatttctggacatgaccactcactgccatttattcaatacctactatgtgctggacttcatgtctgatgatttatatgtattttctgtaggtctcccatcaaccctgctgaaaaacattttgacaatttatacattaaaaacattgcaattcaagaacattaacattctaatattacaaagccaatgaacagaactgccagaatttgatctaaagactgcccacacccaaaacccagttgctttccataatgtgctgtcaggttactttggaaaaaccttaattcatccctgaggaacattttctgtaaagcttctgccatcatcctattagtatttctttactgcctcttacatttctgctaacagcatacgttctcccatcttctgagaatagaagcaatcagccctccctgactctcagttaaagagagagatcccagggtttggcaccatacctgtgtctgacgtcagcttatacccatcctcatgtttgaagtgatcatcctggtatggtctgttttttgtttgaactcttgtagaagatcaactcaggcaaggcgtggtagctcacacctgtaatcacaacattttagaaggccgaggcaggaggattgcttgagctcaagagtttgagaccagcctgggcaacatagcaagacctcatctctactaaaaatcaaaaaaattagccaggcatggtagtgcatgcctgtagtcccagctactcgggaggctgaggtgggagaatcaatgacctaagcccaggaggacgaggctgcagtgagccatgattgtgccactgcactccaggctggatgacagagcaagaccctatctcaaaaaacagaacaaaaaaaaagaggcgtagtggctcatgcctgtaatcccagcactttgggaggctgaggcgggcagatcataaggtcaagagatcgagaccatcctggccaacatggtgaaacctcatctcttctaaaattacaaaaattagctgggcgtggtggcgcatgcctgtagtcccagctactcaggaggctgaggcaggagaatggcttgaacccgggaggtggaggttgcagtgagccgagattgcactactgcaatcagcctgggtgacagagtgagactctgtgtcagaaaaaaaaaaaaaaagaaaaagaaaagatagatcatctctctcttcccggtgctgctgaagggtaagatgtaaacctagagtgctcaagaatgtaaatgtagagagccagcacaggagccagagacagagcggaagcccagggaaggctgttcacacccggtcccgctgccctggaagctagcgtctgctcctttcagtcatgtgcactacaaatatcccttcgtttttcctttggcacaggcaaatgtgggtttcctgtcttttgcattccctaataatacactgccctacttatttcaaactgtatggttaggcagggtgctgtggctcacacctgcaatcctagcactttgggaggctgaggcaggaggatcacttgagcccaggagtttgacagcagcctgggcaacacagtgagaccatgtctctaaaagtaaaaaaattaaaaacaaataaaactatagttcaacattgctggtaggactgtaaaatggtatagctgctctggaagagtttggcagaagcgaaagcttctgttcacataaaatcctgtaaatgggtgatcatggcagcattattcacaatagccaaaaagtagaaacaatctaaatgtttatcagctgatgaatggacaaacaaaatacggtacatccatacagtggaatattaagcagccataaaaacaaatgaagcacgcctacatgctactgcatggataaaccttgaaaacatgatgctaagtgtaagaagccagtcataaaagatcacatattatatgattccatttataagaaatgtccagaaagggcaaatccatagagacagaaagtacattagtggctgtctagggctagggcagaggggaaaaatagcgattgactattaaagggtttcattttggggtatgaaagtgttttaaaatcagacagtggtgatggctgcacaattctgcaaaaatactaaaaaccactgaattgtatgtatattttaaatgagtgaactgtatggtatatgaattattaccacaataaagctgcttctatatttatagtttgacatttaaaatttagtcacacttagagttcaactttactactctactactgaaaatatagagtgtatgaaggatttcctccaattacatgattctaaattgtcatagataaaacactttataataacattctttaatgaagatataaactcatcaagtaaattacaaaggaaacaaaaataacaaggacaaaattacatagtttgatacctcatgagacataattaaattcttctcaaagtttagctgaacaactatacagtaatattttcaaaaa

SEQ ID NO: 33 - DNA, 174538 bp, Artificial Sequence
  Synthetic BAC sequence
gaattcccacgttcttgaattctttgtggcaaaagaagcaagttcgaatccatgcatttccccttcctcatctctatttctctatctcaaaacctcgcctcttcaaggatctccccgttttgaaaactctgctctcaaaaactggtacaaccatcctccagacacactaaaaataattttcccttgaaaaattttaaggttcataatatgtagcaatacatttattatattcctgaagtcatcagaaggcacaattagcattaattttgccttatttcctaaaagtgcatctcccccccgcccccccccccacacacaaagccaacacttgccttcatctttgctgttctgaattaatgtataatttagtgccaggcaaacagttctgaagaaatatttatcagatgagtgaagatttatttctacagaaatacttaaatagtgaaaaaaaaaaaatcttagtccaaactcaaggatcctttttattttctttggggaagatgccagagcaacaagttgcatcctagttttctaggctttaacctgggatcacagaagaccagggatagaacagaggatgtgctaacactatggaatatgatgcagcttcagttccacctgtctccacatcccatgctagtcccccaccctcgtgcttttttttttttttttttttgagacgaagtctcactctgtcacccaggctggagtgcagtggcccgatctcggctcatgcaagctctgcctctcggggtcacgccattctcccacctcagcctcccaagtagctaggactacaggtgcccgctaccatgcccggctaattttttgtatttttagtagagatggggtttcaccatgttagccaggatggtctcgatctcctgaccttgtgatccgccctccttggccttccaaagtgctgggattacaggtgtgagccactgtgccggacccgtgctttcttttactctatggcatgaagacagagaagccagaaaaacataaagctaatccccagggtgtgttttctccctgaagagttgccagatgtgtttcagacagatgttggggaatgtccagagagttttcgccaaaagctgcaggcatgtctttggaagggttttggctaacgtcaggcagtgctggtcttgtggttgatgctgagagataccaaatcctaacaatgaggcatcatcgggttctttaggtggtgccgaagggcaggttgcccggctggcggggaggaaagcttcttctcgctgcaatacatgtggcaggtttgcttcacccaggaacaaacatactgaacaaaatacgtaatccattttcccctacatgtcagagttatctccatactgagttcccattcccttgagcagaacaaaatttactcttgccaatgtacaataaaccatcaatatgggttttctcaaaaatcaaagtgttgctttcttaatcaattcagggttccttgccttcccacctatccatggagttggttctaagttccatgaagtcatcagggaatagggtgggggtgagggaggagccactggtcttgccatcacctgtgttatggactgaatgtttgtgtcccccccaaattcctatgttgaagctctaacccccactgcaatggtgttaggaggtgacaccctgtggaggtgattaggcttagatgaggtcaggaggatggagacctcatgataggatgagcatcctattaagaagaagaagagagaaccaaagagctcgttctctctctcactctctctcctctcttgtctgcacactttctctgtcattctcactctctctgtctctgtctctctttgttccctcccccattcccccaccactgagagaaggttgccatctgccagcctggaagagagccctcaccaggaacaaaattagctggggccttgatcttggacttccagcctccaaaactgtgagacataaatgtctattatttaagccactggcctgtggtgttttgttatagaaggctgagctgaccaataaaatctgtccaggctggtctgtgcaccatcacatctggtttagaaccatgtctgtctgcctctgtgctggactccacacagtggcacaactggccaccagttataaggattatccctctccacccaagtccccttctcccacctgcaagacctctccaggattgctgattttccacatcacatcccacctcctcggtcacctaggggaacctgggctccttccttctccatcaggagtgagtccatagacatgacaccaaaagcacaatctatagaagaaaacaatcaatcaattggacttcaccaaaatctaaaacttttgcttataaaagtccctgctaagaggatgaaaacataagctacaaaccagaagaaaatatttgccaaccgtgtacctaacaagagacttctatctagaaactataaagaaccctctaggccgggcgtagtggctcacacctgtaatcccagcatcttgggaggccgaggtgggcggatcacctcaggtcaggagttcgagaccagcctggccaacatggtgaaaccctgtctctacttaaaaaaaaaaaaaaaaattagccaggcatggtggcgtgcacctgtaaccccagctacttgggaggctgaggcaggagaatcacttgaaatcgggaggtggaggttgcagtgagctgagttcatgccattgcactccagcctgggcaaaaagagtgaaactccatctcaaaaaaaaaaaatctctaaattcaactgtaaataaacaatctgattagtaaataggcaacagacatgaacagatatttcaccagaggggataggcagatggcaaataaggacttgaaaatatggtgaatcttattagctgttagggaaatgcaaattcaaaccacaatgaaaaatatcactacccacctgttagaaccactaaaataaaaagcagtgacaatagcaaaagctggcagctttttgtaaaaagctgaatctctcagaattgagggtggaaatgtaaaatggcacagctattttggaaaatagtttggcagtttctttaagagaaaaaaatcctaaaaattaaacatatgcttactatatgacccaggtatcccagtcgtaggcatttatcccagtactaggcatttatcccagagaaataaaaacatgtctacataaaaacttgcatgtaatttttttttctgaaacagagtcttgctctgttgcccaggctggagtgcagtggtgcaatcacagctcactgcaggcttgacctccaaggttcaagtaatcctgcctcagcctcccaagttgctgggaccacaatcacaagtcaccacgcccggctaacttttttgttacttgtagagatgaggtctccctctgttgcccaggctggtctcaaacccctggactcaaacaatcctcctcccttggcctcccaaagtactggattacaggtgtgagacaacgcacctctcctgttcataaatatttataggagctttatttgtaatagcctcaaatttgaaacaactgaaatgttcttcagtaggtaaatggttaaacaaactgtagtacattgaacacatggactactacacagcattaaaaaagaaaaaaacatcaatgtgtgcagcaacctgaatgcatctcaagggcattatgctgagtgaaaaagccaatccgcctggcatggtggctcatgcctgtaatcctagcactttgggaggccgaggtgggtggatcatgaagtcaggagttcgagaccagattggccaagagatcagcctggctaatatggtgaaaccccatctctactaaaaacataaaaaattagccaggcatggtggcaggtgcctgtaatcccagctactcaggaggctgaggcaggagaattgcttgaacccaggaggcaggggttgcagtgagccaaagattgaaccattgcactcaagcctgggcagcagagcaagactccaacgcaaaaaaaaaaaaaaagaaaaagaaaaagaaaaaaaaaaaaagccagtcccagaaggttatctactgcaggattccatttgtataccattctcgaaatgacaaaattatagaaataagagtagtgttagccagagagggggaagggagggagggttggcgaagctatcaaagggaatttgcatgaaggagatcgctgagatgatgaaatgttgcttgactgtggtgttggatacacaaaattacacatgtgataagatgacatagaactacacctccctccgcgcgcgcgcgcacacacacacacacacacacacacacacacacacacgcaggagagcaccagaggctgctgaagcctgagtaagtttgcggattgtacaatgccaatctctctgattttcatattgtgctatagttgtgcaagatgttaccggggaaactgagtaaatggtagagggaacctctatggactactcttgccacttcctatgtatctagaatcatctcaaaataaaatttttaaaaagtaaagtttttcatatctacatctttgtggaagatgggagtctatgtggaggtggggcagggaggggacagaaaggtctttacctgctgtgcctgatatttttggcagccatgtgtgttgtccaaaggccatccgtctgctggagaatttcctcttgctctggggagttcagtctttgtctgattcaggacttcaactgatgggatgaggcccacccacattatgaaggaaaatctgctttcctcaaatctcatttcaatgtaaatcacacccaaaaaccagcctcacagaaacagaatactgtttgaccaaatatctgggtactgtggcccagtcaagttgacccataaaattaactatctcacccccagtgctgggttgtgtctgttctttcccagtcctcaccttcctctctttctcaacagaacatgtctggtgtattagtccattctcacactgctataaagatatacctgagactgggtaatttataaagaaaagagatttaattggctcacagtctcagcctgtacaggaagcatggtgctaacatctgcttggcttctaaggagcctccaggaaacttaaaaccatggcggcaggcaaagggggagcaggtgcgtcacatggccagagcaggagctaggacagtaccaaggggatgggactaaaccattcatgagaaatccacccccatgatccaatcacctcccacaaggccctacctccaacactgaggattacatttcaacatgagatttgggtggggaaacaaatcgaaaacatatcacctggtaaaagggaggaggactcggagtgaggagaccaaaaagaagagacccacccacccccactgagggctcccagcctaatgctggtcagtgtataagccaaggactctgggaaccacaatgcttcttctgaattctgtgttaaatttctccattctcagtagagctggtggctgcactgcattgtgaaggtattaaatgccactgaatcattcactttaaaatgagtaacttgttgcctgggcgctgtgactcatgcctgtaatcccagcactttgggaggccaaggcaggcagatcacctgaggtcaggagttcgaggccaacctggacaacatatagtgaaaccccgtctctactttaaaaaaaaaaaaaaattagctgggcgtggtggcaggcacctgtaatcccagctattctggaggcgaggcaggagaatcatttgaacctgggaagcagaagttgcagtgagctgagatagtgccactgcatcccagcctgggtgacagcaagacctgtctcaaaaaaaaaaaaatcatacttttaaaataaaaaatgaaaataaataaaatggctaacttgatgttatataaattttgcctcaatgtttaaaaagtatttttaaaaacaaaagaaaaacccatctctcatacttcaatagtgctaatacagtgaactgacacagtaattcggaatttaaaatttgcaacaattgcaagtaggctgggatggagatatagagaaaaatggaaaataatagaatagtgtgttttctgagacaatctgatggttgagctccacagtggcagcccgtctaataggggcttgcagcagcaaataatgagcttcaatggcatgaacattctttaaatgaggacagttcttttgtggaatgaaatcttcaaagcagttcaagattttttaatttattgaagatatttgtccctgcaattcccagatgcaaatgtgttattctactaaaatatcttaaatgtcttgttgatgatgttaattcctaagatgtagagaaaccctaaaagaggtctacatggctgcatccagggactttaattgaaattaaatgcgtacatcaattaagtccacaatgcacaataaaggcagcgagagtttgcatgctaatgatagcaaacacttctattttgcttacgtctgcaaggcatcattctaagtgctttactaacattaactcatttaatcctctcaacaaccgtacaaggtagaggctgtgattatcctgactttacagatcagcagagacaatgagaggttaagaacttgcccaacctcacatggctaataagtggcagactaaggtaggcttactttgtttttcttcttcttcccaaaatactatttaagccctacgaatttaagcctatgtgtgcgtgtgtgtgtacatccatgcatttgtttaatgtcaggtttcagaatttgtgacatgacacaatctttttcaatgtggccgtgttccaaaaataaaaaagatcccagtgggcgtgttggctcatgcctgtaattccagtgctttgggaggatcacttgagcccaggagttcaagaccagcctgggcaacaaaatgaggccctatctatacaaaaaaaaattagcttaacacggtggtgcatgtctgtagtcctagttatttgggaggctgaggtgagaggatttcctgagcacaggagactgaggttgcagtgagccaaggtcttgccactgaactccagcctgggcaacagagaaagaaaagaaagaaaagaaagaaaagaaagaaagaaagaaagaaagaaagaaagaaagaaagaaagaaagaaagaaaggaaggaaggaaggaaggaaggaagaaaagaaggtaggaaggaaggtaggaaggaagaaaagaaagaaagaaagaaaggaagaaagaaagaaagaaagaaagaaagaaataaagaaagaaagaaagagggagggagggagggaaagaaagaaagaaagagagaggaaagaaagaaagagaggaaagaaaggaaaagaaagaaagaaagaaagagagagaagaaggaaggaagggaaagaaaagaaaagaaggaaggaaagaaagaaagaaattaagaaaggaaggaaggaaagaaagagagacagaaagaaagaaagaaagacagaagggagggagggagggaagaaggaaggaaggaaggaaggaaggaaggaagtaaggaaggaaggaaggaaggaaggaaggaaggaaggaaggaaggaaggaaggaatccccagggactattatgaatatctccatgcacacaaactggaaatttttgaagaaattgataaattcctggaaacacacaaccttccaaaactggatcaggaattgaaaccctgaacagaccaagatcaagctcccaaattgaatctgtagtaagaaacctaccaacaaaaaggagccctgaacctgatggactcacagctgaattctgccagacatagaagaattctacaaagagctggtacctattcttattctactgaaactattttaaaacacattctacatagccagcatcattctcataccaaaatctggcaaagacacacacaaaaaagaaaactataggcagatatccctgatgaacatagattcaaaaatcctccacaaaatgctagtgaaccaaatccaacagcacatcaaaaagttaattcaccacgatcaagtatggtttattcctggaatgcagggttggttcaacatgtggaaattaataaatgtcattcaccatacaaaaaaaattaaaaacaaaaaccatatgattatctgtatagatgcagaaaaagctttcaataaaatccagcatctcctcatgattaaaagccctcaacaacctaggcattgaaggaacatacctcaataataagagccatctatgacaaacccacaaccaacatcatgctgcatgggtaaaacctggaaacattccccttgagaacttgaacaacacaaggatacccactctcaccactcctattcaacatagtactggacgtcctagccagagcaataaggcaagagaaataaattaaagacatcaaaataggaaaagaagtcaaatgatttttctttgccgatgatacaattctatacctagaaaatgctcacaactccaccaaaaggctcctagaactgataagcaacttcagtaaagttgcaggatacaaaatcagtgtacaaaaatcagtagcacttctatacaccaatactccagctgacagccaaagcaagaacacgtcccatttacagtagccacacacacacacacacaaacacacacacaaaatacctaggaatacatttaatcaaggaggtgaaagatgtctacaaggagaactacaaaacactgctgaaagaaatcgtagatgatattaaaaaatggaaaaccattccatgctcatggattggaagaatcaatatcattaaaatgccatactgcccaaagcaagatagagtcaacactattcctaagaaactaccaagatcatttctcactgaaatagaaaaaagtattctaaaattcatatggaaccaaaaaagagtctaaatagccaaggccaccctaagcaaaacaaagctggaggcatcacattacccaacttcaaactatactacagggctacagtaaccaaacagcacagtgctggtataaaaatagacaaatagaccagtggaacagaatagggaacacagagataaagctatgcacctacaactgcctgatctttgacagagctgacaaaaacaagcaatgaggaaaaaaactccctatttaacaaatggtaatgagataactggctagtcacatgcagaagattgaaactggacccttacctttcaccatacacaaaaattaactctagatgaattaaagacttaaatgtatgaccacaaattattaaaatcccagaagaaaacctagggaatattattctggacatcagcgttgtcaaacaatttatgactaagtcctcagaagcaattcagtgaaaacaaaaaatgacattgggacctagttaaactaaagagcttccacacagcaaaataaacgatcaacagagtaaacaggctatcaacagagtgaacagacaagctacagaacgagagggaatattcacaaactgtgcatctgacaaagggctaatatctggaatctataaggaacaattaaacaagcaaaaatcaaataaccccatttaaaagtgggaaaaggacatgaacaaatacttctcagaagaagatatacaagcagccaacaaacatgaaaaacaggctcaacatcactgatctttagagagacgcaaattaaaaccacaatgagataccgcctcacaccagtcagaatgacttttgataaaaagtccaaaaattacagatgttggtgaggttgtggagaaaagggaacacgtatacactattggcagaaatgtaaattagttcagccactgtggaaagcattttggagatttctcaaagagctttaaatagaacctccattcagcccagcaatcccattactaggtatatatccaaaataaatcgttctaccaaaaagacatatgcacttgtatgtttatcaaagtgttattcagagaagcaaagacagaatcaacctaggtacccatcagtggtggattggataaagaaaatgtggtacatacaccccatggaatactacacagccataaaaaagaaagaaatcatgttctttgcagcaacgtggatagagctggaggccattatcctaagcaaactaacacaggaacagaaaaccaaatatcacatgttctcacttataagtgggagctaaacattgaggacacaatagacatgggggactactagaggcaggagggaaggaggggaactaggacccaaaactacctatgctcagtaccttggtgatgggatcactcaaacaccaaacgtcagcatcacacaatatatccaggtaacaaacctgcacatgtacccactgaagctaaaataaaagttgaaattaaaaaataaaacaatgcatctctgtccctaataatgcatatgccaattctgtctaaatggagccatacaatttaaattcctaataaagtccattaaatcttcctgcccttctctagctcccctctgttcctcagtttatgctccctcactcttaaaactcccccctggccaggcatggaggctcacacctgtaatcccagcactttgggaggccaaggcgggtggatcacctgaggtcaggagttcgagaccaccctggccaacatggtgaaaccccaactctactaaaaatataaaaattagctgggcatggtggcacacacctgtaatcccagctactcaggaggctcaggcggaggttgcagtgagccgagatccctccaccacactccagcctgggtgacagagcgagactccatctaaaacaaaacaaaacaaaacaaaaaacttccctcccatccaatcttggcttcttgctgcttttcagccatctcttttgctttgtgcactgccaaagtctaaaactaaagcttttaacaaaaagctatcacaatgacctcctaactagtttctcttctgatttttctcctctctaatctttttacgatatcactaggattgtcttcttgctcttaaaaacaaatcaaaaaccacttgaaataggtaatattaaggaaatatgattcattatgtaagctgtaataatggtgttgtggttacataaaaagatattctcagttgaggctacatcttgagtgtttataagtgcaatgattcaatatctggaatttactttaacatacttcaggaaaagctgggcacccaggctcacacatatagacccaggtcctagagaggtggaggcaggaggactgcttgaggccaggagttggagaccagcctggacaacatagcaagaccctgtctcaacagcaacaaaaatttagccaggtgtggtgatgtgcacctgtagtcccagctactcaggaggctgaggcaggaggatcactggagcccaggaatttgaggctgcagtgagctatgatcatgccactacactccagtctaggtgacacagcaagatcccgtctctaaaacaattaatgattaaaaattttaaaaattaaaaataatccaggaaataaaaagtaggaggaataaatgaaaaaaaaagttttcaaatgtttaagatgattgaagtggtcattatggagacatactttcagtcatatcttcccatgagtctccacacttcagtcattccagccttctgcagaccttacgaaagtgcccacatggcccggcctgggagcctttgctcatactgctcccattgaaaacgcttcctggcacctccactcactgaaccctgcccatttttgcaagctctactcaaacactatttcctcctttccagattgtcacagtcatttgtatcagtaccatcaccctttgcatttctgcatggttagttaactgtgtgatccttctgccctatgaaattcctagatcctgtaagacaggagccacgccttagccgctctcatagtcctttgatctgtccacagtgatcaatgtcctgtctagcacataataggtacttgacacatttttgttccattgaaccctacagtgaatgagttcctttgtaaagtgaagagccacgtcataacaaacaattataatgatgactgacacttgtatagctcttaactgtgttcaaggctatatttgaaatgctttacaaagactgactctttacaataaccctatgagataggtatgattattcccgttttacggacaaggaaactgatgcccagagagatgcagcaatgtgcccaaggtcatagctaataaataatacaaactcagtctgtctggcctcaaagactgtactcttaaccacagtgtacactgtctcacctgccgtacagtgtaacaacgtgcactgcctgcagaaatattcggtacataccgattggttgattggctgcttagtttcctgtaataagtatctacatcttctgttttgtaagtgccgtttctgaataacaccttataaatgaattacccttaaatattcattctgtgtgcacattttgtatcagaatcaatctataataacagttacacgactatgtttttggaaaggaaaaactacttcattgcctctagtgatattgggtgtgtatttatttaataccactgcaataaagcccccgtattgtattattattctagtacgacgtagtcctttacatccgccgactgcatatttcatcagcccgcagcgtgaggcgctgttttaccttcaagttcctggtccctggcttagctcaagtcacttccatcagctggaaacaggcgagcacctcacgccatctagcggagacacactttgaagaccgcttcaagggatttgcttaattatgggagtctcataggggcaccatccaacagccacatgaaagtaacaacagacactgagtaaaaccagaatgtttcccccaataagtggctgctctaaaattattttcccaaactctcccaggttgctgccccttgttcctgagtccacacagcagcttcctacggaaaacaccctctgtgattctagaagagcgcactctcctcatccattgaccacaaagacttactttctacacgatgtgaggaaggaaaacaccctctgtgattctagaagagcgcactctcctcatccattgaccacaaagacttactttctacacgatgtgaggaaggggctcccggcagagtcagggtcactgcctggtgcctccggagaggctgcaagttgtcatggaaagcacaaatgtctgtgggatctaacaaaactgaagagcttctgcacagcaaaagaaactatcatcagagtgaacagacagcctgcagaatgggagaaaaattttgcaatctatccatctgacaaatatctaacattcaacaactacaaggtacttaaacaaatttacaagaaaaaaaactccattaaaaagtgggcaaaggacatgaacagacacttcttaaaaaaagacatacatgcggtcaacaaacatatgaaaaaagctcaacatcactgacgattagataaatgcaaatcaaaaccacaatgagatatcatctcacaccagtcagaatggcaattattaaaaagtcaaaaaaacggcagggcacagtggctcacacctttaatcctagcattttgggaggcttaggcaggaggatcatttgaggtcaggagttcgagaccagcctgagcaacatagtgaaacccactctctactaaaaatacaaaaattagtcgggcctggtggcacatgcctgtaatcccagctacttgggagtctgaggctgaggcactcccaactgggtgacagagttagactctgtctcaaaaagaaaaaaagaaaaaaactcaaaaaaacgacagatgctgttgaggttgtggagaaaaaggaaagcttttacactgctggtgggagtgtaaattagttcaaccactgtagaagacagtgtgacgattcctcaaagacctggaggcagaaataccatttgacccagcagtcccattacttggtatatacccaaaggaatataaataattctattataaagaaacatgcacgtgtatgttcattgcagcactattcacaatagcaaagacatggaatcaacctaaatacccatcaatgataggctagataaagaaagtatggtacatatacaccatggaatactatgcagccataaaaaggaacaaaatcatgtcctttgcagggatgtggatggaactggaggccattgtcctcagcaaactaacgcaggaacggaaaaccaaatgctgcatgttctcactcataagtaggagctgaatgatgagaacacatggacacatggccgggagaacaacacacacacgggtctgttggagggtgggggatgggaggagggagcacatcaggaagaatagctaatggatgctgggcttaatacctaggtgatgggatgatctgtatagtaaaccactatggcacatgtttacttacgtaacaaacctgcacatcctgcacatgtacccctgaacttaaaataaaagttgaaaaaaaagaaagtataaatatgtgatgcatagtgacccttcctcagctaaagccactcacctttgttatctatgcaaatgctatttgaatgtgctaatctgagcttggcagcaagttcaagggcctccccaagattcttgcaatttctggggcttattctaatggtcactttgactttctttcatgttcaactcccaacctcagcactctccttcagtggctgctgttatcctataccaagatctggtttccttctacttccaggcacagggaagattgcaatcccccaccctcttgaaattaagcatggccatgcgccttgtggtggccaatgaactacaaatgaaaacgccatgcaacacttccaggtagaagcattcaacccatgtgctcctccatgtttccctgctccctgccacatgccttgcctctttcagcctgggccactggagtgagggccacacagagcagagcccttggcccaacaaaaatggataaggagtatgtccaagaaaaagcaagcttttgttgtttaagccactgagatttggggattgtttgttaccaggacatagcctagcctatgctgactaatacacttcccaaagtaattctctctgtgtgtgtcttgcctgcacagatagagccatggaatatgactctcttgttttttaattctccaaaatactactcactaaagacatcttggaatataggaagcattttttaattaggcattattcattcttgcttttaaagatttttttgcccaccattctcattgccaaaacaacccttccacactccttttgtctcttctaccctcaactcctacagcacacaaaacattttagcaattcctttgtctttttgtctcctcttgaaccaattgttctcaactgtgtcagatctaatgtcctgttttttataataaatattttgacactacctctgctaccccaaaaataaaattaatagataatgtaccttatctagacacatgattttaaaaattgaatataaatttttaattgtaatataaaggaggacatgtccataataaaatatgatttttaatagtcacatacttgggcataaccacaggagaagacattatgaaggagtcggatggttaccaacaaatacggatcaccatgcctgcaacactacaaattcagactaacagagatatggggtatgggttactcatgtaccctaagagcaacagtggcaactgtgatgttacttttttcaagtggtgaacatttcttgattcaaagtacaattaaccttgatttactcagtctttgcattccctcaaaattcaatgtatatgctatagattgcatgtttgtgtcttcccaaaattcccatgttgaaaccttactcccagtggaatgatactagatggggttttggaaaggtgattatgtttaggtgagttcaggaggattaaatcctcatgatgggattactgtaatcccagcaccttgggaggctgaggcaggcagatcacgaggtcaggagatcgagaccatcccggctaacacagtgaaaccccatctccactaaaaatacaaaaaaattagccgagcttggtgacaggcacctgtagtcccagctactcgggaggctgaagcaggagaatggcatgaacccgggaggcggagcttcctgtgagcagagattgcaccattgcactccagcctgggtgacagagcaagactccatctcaaaaaaaaaaagaagaagaaaaagaaaaagacactagctcttgctttctccaccatgtgaggatgcaaccagcaggcagccatctgcaagctgggaagggagcccccaccagatcccagatctgccagcactttgatcttggacttcccagcctccagagctgtgagcaataaatgtttgttgtttaaaccactcagtttgtggtatttttgttatagcagcccaccctaagatagtatattaaaacatttcaaaaatattatgtgaaacagaattaggttataggaccaaagaatttttaacctgcctttcacttacacttacacaatatctggcaaggcacttgtattagtctgttttcacactgctgataaagacatacatgagactgggcaatttgctaaagaaagaggtttaattgggtttacagtttcatgtggctgggaaagccccacaatcatggtgaaaaggaaggaggagcaagtcacatcttacgtggatggtggcaggcaaaagacgagagcaattgtgcagggaaattcccctttttaaaaccatcagatctcatgagacttattcactatcacaagaacagcatgggaaggacctgcccccatgattcaattacctcccactaggttcctcccacaacacataggaattcaagatgagatttgggtggggacacagagccaaaccatatcattccacccctggcctctcccaaatctcatatcttcacatttcaataccaatcatgccttcccagcagtcccccaaagtctcaactcacttctgcatcaactcaaaagtccacagtccaaagtcccatctgggacaaggcaagtaccgcctgcctatgagcctgtaaaatcaaaagcaagttagttatttcctagatacaatgcaggtatatgcattgagtaaatatagccattccaaatgggagaaattagccaaacaaaggcactacaggccccatgcaaatccaaaatccagcaatgcagtcaaatcttaaagttccaaaatgatctcctttgactccatgtcatgcatctgagtaacgtttatgcaagaggtgggttcccatggccttgggcagctccatccccgtggctttgcagggtacagccaccctcccagctgctttcatgggctggtgttgagtgtctgcggcttttccaggcacacagtgcaagctgtaggtgggtctaccattctagggtctggaggactgtggccctcttctcaacagctccactaggtggatacccagtaggcacctcccatcccacatttccctgtcttattgcccttgcagaggttctccacaaggacaacacacctacagcaaacttctgcctgggcatccgggcatttccacacatcttctgaaatctagagggaggttcccaaacatcaattcttgacttctgtgcacttgcaggctcaacactatgtggaagctgccaaggcttggggcttgcaccctctgaagccatggcctaagctctagattagcccctttcagccacagctggagtggctgggacacagagcaccaagtccctaggctgcacacagcatggggaccctgggcctggcccacaaaaccattttttcctcttaggcctctaggcctgtgatggaagaggctgctgtgaagacctctgacctgccctggaaacattttccacattgtcttggggattaacattaggcttcttgttacttatgcaaatttctgcagccagcttgaatttttccccagaaagtggaatttccttttctattgcattgtcagactgcaaattttccagacttttatgctctacttcccttataaaacttaatgcttttaacagcatccaagtcacctcttgaatgctttgctgcttagaaatttcttctgccagatagcctaaatcatctctctcaagttcaaagttccacaaatctctagggcaggggcaaaatgccaccagtctttttgctaaaatatagcaagagtcacttttgctcaagttcccaacaacttcctcatttccatctgagaccacctcaacctgggctttattgtccatatagctacagcattttggttgaaagccattcaacaagtctctagaaagttccaaactttcccacattttcctgtcttcttctgagcccctcaaactcttccaacctctgcctgttacccagtttcaaagtcacttctactttttcgggtatcttttcagcagcataccacttctggtaccaatttgctgtattagtccattttcatgctgctgataaagatataccagactgagactgagcaatttacaaaagaaagaggtttaattggacttacagtttcatgtagctggaagcctcacaatcatggtggaagacaaggaggagcaagtcacatcttacatggatggcagcaggcaagaaatgagcttgtgaagggaaacttccctttttaaaaccatcagatagtgtgagacttactcactatcatgaggacagcacaggaaagatctgcccccatcattcaattacctcccactgggttcctcccacaacaggtgggaattcaagatgagatgtgggtggggacacagccaagccacatcagcactcatatgttttgtgttactaaagacaattctttatttttaagtcttgtcctgtgcatagcaggacatttagcattcttgacttcactcaccaaatgctatcagtctttcaatcatcatagcaaccaaaaaaataaccccataaatttcccaaatgaaccctggtggaagttcacctcatggttctaaaatattccaaagtggaactcatcttttatcacaaatcaagggtgtatgtgtgtttatttttacttttgtatttatacatgcacacacacactcacatgcacaggttaagttctcactttgtgttatggtgctgtaaacatcatcattgaggcagatgttgtgcaaactaattttaatcaacaggataaattacaattataaactgatctttaaatcgttttcaaaatattaaaagctttgttcctgtcagttataaatgcatagaaaattttttaaatgataaaactatttaaaaaaccatatattaaaatattaagaattaaagtactttatatatttgtttaaaaacttattcatagtagtttgagaagggctcattttcttctcgttgtacaattttggatcctaagtgagcaacttgtttatgcctcaagaaattgtcctacccctttctaagtttgaatccacttccagtgtgtgtgtgtgtgtgtgtgtgtgtgtgtgtgtgtgtgtgttttcagtggtcaaatatcttcagaacttttttacaatgtgttttttgctggtgttctttggcttgctttctccaagacatcatacttttcatcacaaccactttcgttatttctgtcagtaaattcaccttctcaaagtctctctggctgcacacctagagtcttgaagtgggggcagggtaggggcaatgtcaaccttcccctggtcagctatttcttctataactacatttatgatcaaactcaaattttactcccagcattgtcagttttcttagggactttcatttttattagccattctctctttcagttatccatttttgtaaagtgtcacatgagtttatcactgggagataaggaagaagcacaagtacatactttgctgtctgtgcatgaacccaagaacagatgtgcagtgaccaagactgggaaaagaatgagaagctgtgaggccattggtcaccaatcatgcttctatgcaaatagcagatgcatcatcggcatctgctattcacacagtgatttttggatgagagggctggtagccaagtgtgtgctctgtgcaattcctcacatggacatgctacagtaattgaaacttaaaccatgttgttggtggactagtgtcatttaactaaatcgtagtaacgtaaatccatgcatggcaaacaaggactgctgcgatataatattctatatacagaattggattttctggagagatgatataccccttccttaaagacaaaagcagcttcaatcagttgtgatttcaagcatgatatttttttcttgtctatatagacacagagtaatactcaagaaataggagcccactgtgcagataaattgacaacctagtttgttttttgttttttttttttttgagacagaatcttgctctgtcgtccaggctggagtgcagtggcaccaccttggctcactgcaagctccgcctcccaggttcacgccattctcctgcctcagcctcctgagtagctgggactacaggtgcccgccatcatgcctggctaattttttgtatttttagtagagatggggtttcaccgtgttagccaggatggtctcaatctcctgacctcatgatccacccaccttggcctcccaaagtgctgggattacaggcttgagccaccgcacccggccaacaacctagtttctatctagaagaaacaaattatggtaagtttgtttatatagatcaggtcctatataaaaaataatgccatacatgttttaaagggccaattttttttgtttttcttattgctataacttaaagaataccctagaaccacactgactcaaaattcttctcttgttggtctgcattttatgctgccttcttttcaaagtttatctcaaatggactctccaaataaaggaagaagaaacctaaacaagaggagagaggtgctctgaggcaagacggtaatgggaggaaggctttttctagctttctgttgaattatggaaacttcacagtccctagaattcatctttcaatagcctccatctccaatgcaagaatcccttcattcccttcctaaaatctggtcttacagcctctgtttagacacttcaatagcagaaacactaataataataatattattaatagctatttaatgggaatttgttctgttccagttattataaagatctttacatgtgtcatttctcatcatctttaataacataatatttgttagatgatgattttcatttttgactcagaatctctaaaaccccatttccttatgccatttccatgccccactttccttgtagtggattaaagatggtcccaaattccttgccattcttctaatcagaggtggggtttattgcctgcccctccccttgaatcatggctgtccttgagactcgatttgcccaacagaagtgcaacagtgtaatttccaaatgatgggccttgcaagatagacaacttcatttctgcacactgagaatgccccttcttgaacctcagccatgtggggagaaggctaggtcatgtggggaggccatgcagaggagaaccgaggtgctctggtcagcagccccagctgtgctccctgtcaacagcaccaatggccagccatgtgaactgagttggatgttattccctagccgaacctctgctgaccatgggcccagccaacagaccatgcagcagaagaaccatccatctgaaactagtcaacccacagactcaggagagagattaaactgttgctttgaaacactaagttgtgcagcagtcaataattgaagcattctagaggcaataaccctctagaaatacagtgattaagcccagcttcacagggcagtttggcccaactgactaccaggagaagcttgtcctggcccaatgaatcctgcctcactgcacctcaaaggaatgtgctggcaggtgcccagcactcatggggtgagttccagaacggccagaatggcctggcttcactcacttgaacgccctctgccacagccttgtttgcacagtgtggacctcacgcattcttctgccacatagactggcacattcttcaaacttctgatttcttttcccagattctgactttattccttaattccagcctgaagtctccatagaaaaataaccccgtaacgaacctcctcaggcctcgcacgtggatcattgccatacttacctcaccttctcatttttcttgaactgtgtattaatagcatattcttgtgcaacagttttgaatctctatcctgacccaccttcaatggtttaatttagtaaaatcttttatataatattccactcagaattgaatgtgatgttttaggtatggtctacactggagaatgcactgagacttttctgtagcacttctagaatttatattcagcataccttctttttcaccattcatgtttatttcaagcatatttcatttgaaccactttagtgaattctagggccctgtttcttaccactaaattaatttcttcaagttaacatcattgtagtcatcaatgcttttctggttggatttgttcaaacaactggttctataattaaccagataaaaattcattccattttcatttcctacctcatccatgataaacacattacagtcgatctatgcttatcgaatctggatctgccagtttagaaacagcacagcaaagaggagtaaaattagctcaacttaatgttcaaccaagcactgtgtcaccaccaattcttcaggcagtaaatggccccttgccatttgcaagctctaaaatccaagggaagaatctggctatgacatatgggaagtgtttatgggttatgtgtgtgttaccagctcctggggctgctgacaagttagtctccctctcaatgtctgacgaggactgggcccatgtctcgggcttggactcaatatctgacgaggactgggcccatgtctcgggcttggactcaagcccgatatctgctatgcctgaagacgtggttcctgttgcctcctgagacccttatgaaggccttggcagcatggagtgactcatgcctgtaatcccagcactttgggaagcctgtgcaggaggatctgttaagtccagaagtttgagacaagcctgggcaacataatgagacccagtatctacaaaaaaaacaagagggtcttaacaccatcttctctgcctagctttatttccagactctgccccctttgcccccacctcctggactgtctttcctctgtcctcattggtgtgaggaccctcccactgcacacctattctcagtgcccagtgagcttccactttgtccccatcccatagctagtgagcctcagtcgtcaaacccctcccatacacacgtgtcaaatttcttccttttcaaaagttttctcaaaccatctttttaatcactgcatgtcattttttaaatcaagtctactataagctcgccaatctatatttacagaaatctagattttttcctttttgaaaactgaagtaatctaatagtcatcatttacaagcattttcaattcagaacttctttctgtgccctgccgtgtaattagtctgggaaacaattcatttaaatgacttcaggccgggcgtggtggctcacgcctgtaatcctagcaccttgggaggccggggcgtgtggatcacctgaggtcaggggttcaagaccagcctggccaacacggtgaaaccccatctctactaaaaatacaaaaattagctgggcatggcagagtgcacctgtaatctcaggtactcgggaggctgaggcgaggagaattgcttgaacccatgaggcagaggctgcagtgagctgacatggcaccactgcactctagcctaggcaacagagcaagactccatctaaaaaaataaaaataaatatgtagagaccaggtcttgctatattgcccaggtctcaaattcctggcctcaagtgatcctcccgacttgacctcccaaagtgttgggattacaggtgtgagccactgtgctgacctgttttaacactactactagtaactagcacttagttagcacctaatgtgttccaggaactgctctaagtccttcatacatactcataggtgagtattatttgttattcccatttttcagatgaggacgttgaggcatacagagatttgccaaaagtcatgaacccagctcgttagtcaaagaggcaggccagggaaggggttgatgacgacgctgccgactcacactgttcagtccattttccatcgttaccgccaacctcggccctgtatcttgaccctactccacttctctagccacagcctggcatggtacttaatgtggagaaagtctgttttctatacgtatttgagctgtgataccttccttctgattgtaaagatattttcttatagcttcttcaaggattgtctatttgaatttccaaagatgacattcaattactctgctacatcttttcccctctcttggccacatgacttaaccactctgagcctcactttcatcatcttttaaattagaggatccagctagataacctctaacatccctggtggctcagatatccaaacacactcttcgccctgtttacaccttggagggagccacaattactcatatgaaggtgcttcccagcctgtacctgaaataccagcaccagatcttagtgtgatcgtgagaccacttccagatgagaccccttcctcgccagaaaacacccagacaccctgggaggaacagcaaaagctgctacactggaattgacctatcgtggctggtcacatgtctactctactctcgatttctctactctggcaatggatttgaatttgaacttcagaggtaaggaacacagaataggaaagaactgaaatggctcaacagcaaagccacgtttccatggcttaagaaccaatgagagaatccgttccatgctctctaacttcccatttttggcttgtgatactgctattcagtttcaaatatttttcttttgaaacatctttatgttctggcctcaaatgatacaaacccacacctggccaggcacagtggctcacatgtaatcccaacactttgggaggccaacatgggtggattacttgagtccaggagttcaagaccagcctgggcaacatggtgaaacctcacatctacaaaatatacgctcacacaaaaatcagctgggtgtggtggtgtgcacctgtagtttcagctactcaggaggctgagatgggaggattgcttgagcccaggaggttgaggctgcagtaagccatgattgcatcactgcactccagcctgggtgatagagtgagaccctgtctccattaaaaaactaaaacaggctgggcgcggtggctcaagcctgtaatcccagcactttgggaggctgaggcgggtggaccacgaggtcaggagatcgaaaccatcctggctaacatggtgaaaccccgtctctactaaaaatacaaaaaattattcaggcgtggtggcaggcacctgtagtcccagctgctcgggaagctgaggcaggagaatggcgtgaacccgggaggcggagcttgcagtgagccaagattgtgccactgcactccagcctgggcaagagagagactccatctaaaaaaaaaaaaaaaaacagaaccaaaaaaaacacacctctgcattacagaggacaaaaaaatgtagcagagtaatcaaatatcatctttggaaattcaaacagacaatccttgaagaagatgtaacaaaatgtcttcacaatcagaggaagccatcacagctcaactatgtgtagaaaacagacctgctccatgttatgtgcaacctgacccaccaaacaagcaggtcagggtcaaatatagctatttttctggtgaattcatccagctttgactttggacttttacaaacatgctctttcacaatgacagggctggagctgaatgctataaatgtgaggcagctattgttatactgtcagctaaaccacaatgacttacactcagtgatgaatctcaagtttgttgatatttcccagagttcccaatgagtactaaatgttatctctttgttcaaacattatgaaatattgtgattttttttcttgtagatttcctactgattttcacatacgtgaaagtgaatattcttgtggcatttatggtagtgatttccatcctagaaatcagtggatatattcaattcaccacgtcacagctgcccaggcatgatgggaggggttggcagtggggtggggagtgcaaggggaaagggtctcaggttcaagactcagtagcctgaatacacagcctacgcggtcgtgcttctgaacattgagagagagagcaaatgttgttttgttttgttttgttttcaagaatttgggatcaggctgagcacagtggctcacgcctataatcccaacactttgggaggctgaggcaggtggattactcgaggtcaggagtttgagaccagcctgaccaatatggtgaaaccccatctttactttaaaaaaaataatacaaagttagttgtggtggtgcacgcccgtaattccagctacttgggaggttcaggcaggggaatcgcgtgaacctgggaggtggaggttgcagtaagccaagatcatgccattgcgcttgagtctgagccacagagtgacgctccctctcaaaaaaaaaaaaaaaaaaggactttgggatctgaagacagagtatcagcatggaaaaaagtccagcctgcttttggtttggtttattctgagataattctgaatatcagattaaaataatcagaaaggaaatgatcaatggaaggaggtatgattttgaaagtcactgctgtttttgggagaacatgccattgggttttttattatttatttatttttttcttttgagaccaagtcttgccctgttgcccaggtggaatgcagtggcgtgatctcagctcactctaacctccgcctccccagttcaagcaattctcatgcctcagcctcccaagtagctgggattacaggcgcatgccaccacacctggctaatttttgtatttttagtagagacggggttgcactatgttggccaggctggtctcaaactcctgacctcaggtcatccacccgcctcagtctcccaaagtgctgggattacaagtgtgagccaccgcgcccagctgccattgggtcttaattctccagaaacagtatctcagtcaagaatgcaaagctgtggcaggatttttccatgaggggtccactgaggcactcactggccaaggtgggcgctcaactagtccaacctaggcaagggaggggagaatctgttttctcccttccattatttcagaagttatgtttctccagcagacacacggctgtgcaatttcgaagactgaggggaaactagggaggaaaatgcagaaaactctctgttgcatgccctgtgaattgggctttaaatgtagcaaggagctccaggatcccagaagttggcctggggtgcttggtcctgaggataagacaacctcccttgtattgtaattctgcccacagctggagcttcctatttcagtgttgcatccaagaagttacatttcctgtttgttgcaagaaaaatagaatctgaccaggatggaggctaggcatgggggctcacatctggaatcccagcagtttcggaggctgaggcaagcagatagcttgagcccaggtgttcaagaccaggatgagcaacatgatgaaatcccatctctacaaaaaatagccaggcagtgtagtgcacacctgtagtccagctactctggaggctgaggtgggcagattgcttgagccgggggaagttgaggctgcaatgagctttgatctcaccactgcactccaattctgagactggggagtattgatttgccactgacctgagcccggctgataggggcagcaggacagacactgttaccttaatcaaagacattcacgaagcattctcactgaagatctgccctagtatcctgcacagccacttgcctgggtctttataggtaacaggtagacagtcatcaaagagataggggaaaacatgcacaatgaattctttgctcagaaaaacccttctgtgtcttctcccactttttctaaatttttcctgctttcatttagatcaaaggattttgtttcttggaatagttctgcacttggtcctttagaaaggatgacaattatctgtaggtctctctgattttaagatcaatagaaatcagcaaaagccaaaaaataaaaaataaaaataaaataaaagcacacaagcacattcaagcacatccatctgcccctgacttgtcctcacagtaagcaactgcttctgactttgctgtttgaataacctctgggtgttcgatccacccacacagctcaagtttgagctccagaacaaatatttgtcccaattttgaacaaagttagagagttttttcttcttttttcttctttcttaaagcgaactgtactcctctgctgttcctttgaacttggttcagtaggaagaagtgatatcctccccagaccatctgctttggggagcttggcaaaactgtccagcaaaatgaaaagactcacgtgctttttcatctgcttctttctttctgaagtatcaggcttcgaaatccccataaatggactttctgaagtaagtacttacagatcactccttgctgttggcttgttcatgagctcagtaaatcatctattggaatcgctattcaatggccttattctgtgtgtaatggaaacttaagataaaattcatctgagtgcaagtgtttactgttataattactggaatgtatatttaccttttaaagcattaacaggttttgcatgaaaattaagtcaagatcaatgggcaggcatcagagcgtagcatttatggagcagagctgctcactcctcacctaaaaaattgggggtaagaatagacctaacccaatggtttgctttgagaattaaatgacacagtgtaaactcttctagcagagcgcctggactagtaagtgcttaataattactagctgttatgatgatgaagaaatattatcactcttttactaagagtataagaaaagtcattatcaaagcacactgtttttcatatctaagtgaacagtgatatttgtaataagagcactttaagtattcctattaaagcggaagatagcaggcagggtggaaaagtacaagaataattcccatggagtacaggtctccacttttgtcccttagccatctccaatgtaaggaaagtcttggactgaaagtctgtttctgaaagtcatacaagagctatttttatgccagaaaagcgaagcatgttatgggaacatcccagcaaatgcaaaggcttataatacttgcagagtggattacctataaaaatgccagagaatatgacggcatatttacaaagggaaaatatcactctgtctgctttgaaactatcatattttccaacacttaaaagccaccagagtgtgttagaaatctcaaattgaagccaagacatccaaatgtgtttgtgctttttcagtcatttctaactggcatttccttttagaaaatacctacatttttaacttggggagatgtatggttcatgtctgtccagtcagacactgcaaatgcctccagggtctacccagatacttccccagacacccacctaatcactgggttgttttgatctctgtcttaccacctgctggcaaactcaaaaatgaattcccatgtccaacaaatgcgaaggtgttgttaccctccatttggacacctctgagacgtaaccagcaaatagaaatatactaaagaaatcattttatacaaaattgtgattgcccagaggtagaggaaagaatataaaataatgaataccaacagctatctctttggctctagatcttttggaaatcatcattctcagcaaagtaacacaagaagggaaaacccaacaccgcatgttctcactcataagtgggagtcgaacaacgagaacacatggacacaggaaggggaacatcacacactggggcctgtcagggggtggggggctaggggagggatagcattaggagaaatacctgacgtaaatgatgagttaatgggtgtagcaaaccaacatggcacatgtatacctatgtaacaaatctgcacgttgtgcacatgtaccccagaacttacagtataattaaaaaaaaaaaagttaaaatcctaattttttttaagtttgtagactatgaagatcttgtggaactggccccaggcaaatttcaattggtggcagagaaccggagatatcaggtatagtaaggtttactcccaaaagggggaaaaaaagtgaaagagattatggcagaagaagacaagtgttaagatgccttctgctagattttcttaagagtttgttttttagcacagaagagtccagacttcttacaccttggtggaagagatcacccaggtgaaataaaaagagaaactcacacaactgctcagcagccttcacaccataatgctcaatttagtcccttaaagagtacacgactcagcacagtggctcccacttataatcacagcattttcagaggccaaggagggaggatcacttgaggccaggagttccagatcagcctgggtaacatagtgaggctctacctctgccacccagctaatatatatattagctggcatgcacctgtaatcccagctatttgagaagctgagatggaggatcacttgaacccaagagttcgaggctgcagtgagctatgattgcaccagcctgggcaacagagggagacgctgtccccactccatttaaaaaaaaaaaaaaaaaaaagaatacatggctatgtgttttcttcaaaacttaagattccgaaattatttcctgccttgccggaaggatttcctgttaggaagacttttcttattttagcgatgacagacactcccccttgcagcctcacaatctccttcctctggtcactctgagggcacctgagaaggagaattggccacattggaagttgcaatcctggcggccaccagcagcagtatagacaaaaccctctaattaagggggtgagttttccagaacaccaggaagggcttggcttcttccccacggagcccacatgctgagagaggaggtatttacggaagcagcaaccctaagctgatcaatgtcttattttgtatgggtgtgaattttttactttctgaaaatccaggatttttttttgtagactaataatattaaaatccaataagcaagacttcatgtcacaatttatttagccacaagagagaaaaatttgtcattgagcattgcattcaagaagtctacaagaagaggtcaaccattgacctcaccatgtcacacagcacagaacctcagttcaccccgaatcaggcaagctgagcttatatccaacacccgacttcttggatctattattaacagctcaccaaacattacatgttcacccaccacccttaagccattcactttcaaaggcaagggaatcgcctttgttcatttcctcaggacagtcaagtgtatggataatctcctagcatggtggttaaaagcatagaattttctaggtgccagtcactgtgtttgcctcaggggttacactgtggaggaaatacatgaaaatccctgcttttatgtagcttagtttaaaggaagagacagactttagtcaaataatccctcaaatagaatgaatcattatgaaacaaggtgagcactctgcaggaaggaatatgctgctgcaaaaacacttagtaaaggaaaccgacctagtcttggggtgttagagattttcactggaggaattctgctggagctgagatctgaagggtgagtaggagttctccatatgggggttgaggaacctagcaggggcactgcaaacagtgggaacagcatgcccacagcctcatggccgaatggaggatcaaagtctccattcaactgagtaaaaaatagagcaaatagcatcaaggggatatacgctacccaggatgcatttggttgaatatttttatttaaaaattacttgttctagcattatatccaagaatgacacacacgccaccagaactggttgagaaacttattgagaaactcaccagtgggaaaatagttttcaagaatattcaatatttatgtctcaactccagtgaatgaataacagctcagtattgaagaaaaataaaatttcttttttgactgagaaaacggttttggctctcaaggtaataagtgacatacagttgaagaatgattgtctaacttcctttcacagagaagccttccaggagaatcggaagaaatgatggtaagttgacttgatgttgttacagattgaatgattttcctgttaataattaccaggaaatcaatctgggtgtctcttttttcttcatcaccgagtatttacctgactttcgaaatactgccttgcccaactgtttgcaagtgtttctaaaattcagcattgaagagtgcagtctttacagacaggagagaggccaccaagagctgaaggggcccttctcttcattttcttgagttttgccatatatcataggttccttcccactgtataaatttatgtatttattcctactcaacctttttgatttatgtatttatttttacgttttcatttttatttttatttttttgagacagagtttcacttttgttgcccaggctggagtgcaatggcatgatctcagctcactgcaacctctgccccctgggttcaagagattctctgcctcagcctctcaagtagctgggattacaggcatatgtctcctcgcccagctaatttttgtgtttttagtagagatggggtttcaccatgttggccaggctggtctcgaactcctgacctcgggtgatccacctccctcagcctcccaaagtgctgggattacaggcatgagccattgcttccagcaccattttgatttaaagtatgacacctgacagctttggaaaataaaagagtgcccgtggaaaggaacttttaaacacaaaacggcccagttccctgagatgttcagagtagaccatcctgtggcaagaaaacagcctgaggacaagtggcttatgttgtgcttcctgccctgaattggcagaaactgccagaagtgcacacttcagggggaggaaggacacatagattagcctggattttattttagcttgaggtgagttgcatggttaattagtcgaaaggtttaatgttggactacaaagtttggggaatgagacctggtattgagataagtaaattcttttggagaaaaaagcaaaatctaatgggtctcatagttgtccatagacctgaaggagcttgcagctctcagtcacctcctgaaaggtgtgggtttctaggaccttgcctttgagcacacttacatatgtgattcttcacacaggagctgctttaaatcagtagtgatcgggtaaggaggtccagagtgttggaccaatacttgcatcagaatgccctgtccaagatcaatgtctcttgcttacacccgtcactgttctcctagcttgttttgacttgggggaggagaaaaggactgcagatgaaattgtaatagaggagattaaagaaggtagagagctgtaagggggggttggtggaggccatatgtgtgtttccaccccacagcacccctgtgtgacccctactaaagatacaaccaagttcctctttcaacctcgcaatccagtatcctctccccagctgatggtcttgcatttggagttattacctggacttcctcaatccaatctggcttcccacaccgttttctacttgtattctaatttttgaaaaatcattatttatagactcatagggctgaaaaatgccttttagctcaaagtatcttgaaaccaaggcagacttctgctcattgcgggttccaagaagttaggagaatgcttaaccatacatgaattctgtccttaccaaggccctggaattgttctgctagtaaaacaagtaaaatgtagtgttgttaacatcaaatgcactacatttgatgaagttctgtgtgatttttctatcagtacagttatgctttcttgccaatttcaggaagaggttgatcaagtaactctttatagctataaagtccagtctactattacttctcggatggccaccaccatgatccagagcaaagtggtgaacaattccccgcagcctcagaatgtcgtgtttgatgttcagatccccaaaggagcattcatttccaacttctccatgtgagtaacttctgtgtagagccagaaattgtaggtgctctactcacagaatcaaaacccctcatagttagaatggactttagtggtcaactgtcccagaggaccggctggatgtcaagggtcattgtgaggttggtcccaataattttctcctcttcaaagcgttagaacttgtgaattatttgctttttgtttctaataagctaaagcaaacttaaggctatctctgtggtaacaacctcatacttacttgcattttaatatactttctagggaggagaaaaatatactgggttgccctggcttataggaaaccacataagagcgtgtgcacagcaggtcaatgccatctgccatatgtttctctatgggaaaaaaaaaacaagttgagaaccacagattaaatctaattacttatccagtgcttgacctcctctataacaccgctgacaagtgtgtgatgatttccttgatgataaactcacttttcccaaggcaatcaactcagtgattgacagctctgttaagagtcctttcttatacttcaaatattttccactttctacccaatgactctagtgataatcacatagaatttttaaaaagctctctacaaaatacatattgaagtgttcatagatgaaatgatgtgccatctgagcttggcttcttttttttttgagatggagtctcgctctgtcgcccaggctggagtgcagtggcgtgatctcggctcactgcaagctccgcctcccgggttcacaccattctcctgcctcagcctcctgagtagctgggactacaggcacccgccaccatgcctggctaattttcgtatttttagtagagacggagtttcaccgtgttagccaggatggtctcgatctcttgacctcgtgatctgcccgcctcggcctcccaaagtgttgggattacaggcgtgagccaccgtgcctggccttgaacttggcttcttaacaactaaggtggaaagcatgagagtacagacaaattaagattggctgagtattcataatggtgtagctcagtgatggtttcatggacatctcatattattccctctattttctgtgtgtttgaaatttttcgtaataaaagaaggttaaactactccaatactttccaaacagttaataccagttatccacttggagccttcatgtatcaaagttaaatattctctgttcctctaagtgattggaatgatttctatgtccaaatatcaaggtggccaacccagagtatgttccaggtggtcaatgtccctcttaagttgccaagaacacagcaaagtactgtgcataaagtctggctattttttttttatgaagacattaggttgaattacttctcatccacttttgtctttcatacaccaaggtaatcagtgatcattgtggataaatagtaaagggttcaaccaccatgtactttggctgccgaaagtggcagtcatgtgaactctaaccaaataggcagaaaaaggcattgtgtcactttaattggtatcctttgaattggctttaaaatgtatcactttttttgtctgccttttctaaaaagcaaagggagaaggaaaggcttttctgtactggtattatatgaccccatgtctagaaatgacattgaaaactattttaataaattcctatttttaaaccacacaatcagaatttactcaaaagatctcttatttctgttttccttcttttttttttttcttttttactttaagttctgggatacgtgtgcagaatgtataggtttgttacataggtacacatgtgccatggtggtttgctgcacctatcatcccatcatctaggttttaagccccacatgcgttagctgtttgtcctaatgctctccctccccttgccccctaccgcccgacaggacacggtgtgtaatattcccctccctgtgtccatgtgttctcattgttcaactcccacttatgagtgagaacatacagtgtttgattttctgttcctgtgttagtttgctgaggaagatggcttacagcttcaaccatgtccctgcaaaggacatgatcttattcctttttatggctgcatactattccgtccttcattctgttctttctttactatctcattacatagaagatttgaagtacaaaggacagaatcgtgaaacatgcatttacttttatctccctctgctctgagctgaatctataagaccagagaagatacctgcttaattatcacaacttaaaatgagctgtgtagacctatgtactagccaaaatatcccttttacctttttatcaagatcttgaatattctatgggagatgatttcctttgtcctaaagaccccttggcctttgagacttagttctgattcgatagaagcatgatggccttgaccagcagtgtgaccttggcaagagtcacctgtctcctggggtctgatgtctctcatctaaaggggcaaacccacaagtgtgcctcaacacacgtgctgttggcatttggggcaggaaaattcttcagtggagctgtccctcatattgcaggatgactaacattcgtggtgtcctcccacaaatgccagcagcacttccaagtcatctcaacaacccaaacttcacacatttccaaattgctccttgggaaagacactgcccatttgagtactggaagttcccatgtacttccaaaattctggattctaccactctgaccaaccattacttggtaaggattaggtgctagccagctaaaggtaaggtgtatagagatgagatgcaaatagaagacagaggtccccaagggagatggtttccagataaacaccaccttggcaggggacccaccagcaccttccccctttttctttattcttttccacccttgcagaggagcataatattctgtcttcatcagctccggctgctatgactaagtaccataaaatgggtagattataaacaacagaaatttaaaattcatagttctgaaggccgggaagtccgagatcaagatgcccaaggatttcgtgtctggtgagggcccatttcctggttcagtcaagatggaaagagatgagagagctcttcgaagtctgttttttatgacagcactaaatgctattcatgaggagagagccctctccaaggccccacctcgtaatgtcatcgtcctaggaagtaaggttcaacatgcacatttgcggggaacataaacattcggtccattgcataccccacagcgatgccaaattcttagctcacagaatgacctgatgaaccagtaatgagataattcggaatttatcagtcacctcccctaatcacatttgtcattcaaaggggatacccaaagagaaccatccttaatctaaaggatgaaattcaaagatgaggaaaaatctataaacaaacaacagtacatgagggaaaggttttaggatgggagcctaccaaacccctctcaagccacactatccaatcaataaaggaagtcctgtccataaactatttgaatgcctcccttcttatttcttatagacacaaaatgatcattgccctcattcattaaattagccttgttgggttgtttgctcgctcttgtttgttttgctaagattactattctgggccaggcgcggtggctcacacctgtaatcccagcactttgggaggccaagccaggtggatcatgaggtcaggagatcgagaccatcctggccaacatggcgaaacccaatctctactaaaaatacaaaaaattagcctggcctggtggcagacgcctataatcccagctactcagggggctgaagcaggagaattgcttgaacccaggaggtggaggttgcactgaactgagattgcaccattgcactccagcctgggtgacagagcaagactccatctcgaggggaaaaaaaaaaaagattactattctgaccaactggttaccttctgtcattttctaggactgtggacggcaagacatttaggagctctattaaggagaaaactgtgggccgagctctttatgcacaggccagagcaaaaggcaagacggctggcttggtgaggtaaggcctgagtgagcaaggcttgcccttgcctctcaatgacggtttcctctcctacttccttcccacagcagcaaagcagcctctggaaaggcacagcacctgagccaatggcaacctcctcagagccagatgttagaattaggcactgcagtttctattcgcctaaaggtccctcttcaaccaatgggttttgggtgatcccacgctggttgtgcttacatcactgtcttgcaggtagatggatgttctgtaaataaacactgctttttctaaagagtgaagagagaaactacagaaatattggtgatcttgtgatcttgttacgaaacttaacatataagcagaaggaaaagtttgaaatttgccttaatgatttattctgactacttgtagggataaggggttttttttaattgtagttgttgttgttgttgtttgagatgaggtcttaattttttgcccaggctggaatgcagtggtttgatcacggctcactacaacctcgaactcctggccccaagcgggaatgcctcagcctcccaagtagctgggacttggggtgcaccaccatgcctgacgaatttttttagtttttgtagagataaggccttgctttgttgtctaggctggcctcaagcgatcctcccatgtcagcctcccaaagtactgggattacgggctgaaaccaccatgctgggctgcgatagggtcttcttaagcatcagttacttcacttaggctttgtttattttttccccttataatctaagtaagacctgggaatgccaagccaccctcaaaaagtagcttctcttcaaagggaaaaaatcttcaaagggatgttcaccttctcactccttgcactgcacactcactattttttttttttttttttttttttgagacggaatctcgctctgtcgcccaggctggagtgcagtggtgcgatctcggctcactgcaagctccgccccccgggttcacgccattctcctgcctcagcctccagagtagctgggactacaggcacccatcaccatgcccggctaattttttgtatttttcagtagagacggggtttcaccgtgttggccaggatggtctcgatctcctgacctcgtgatccgcccgcctcggcctcccaaactgctgggattacaggcgtgagccactgtgcctggcccacgctcactattaggccaaatgctgccgtgtttctttcctcctctcctcttctcttacatccccaaactcacctgtagttgaagttcttttcctttcattcatgcatttgttcattcaacaaaaatgcatcaaatgcaagctctgtaccagttctgtcagagacagcagcaacacaaaagcggacaccgtcagcctcatgcaggagacagacaaggaacctgtgacaacaatatctgcagtgggcaagggctaatacggaagagagggtacacaaaaaacactatgggagttccgagtgccgagtgtgtcatcctgtctgggggtccaggaaatccccacagaggactgatgtgtcagctgagcccaagtagattacagctggccttcgtattcatgggtttcacattctcagattcaaccaactgtggatgaaacctgtggatacggagggtccactgcaccatactgttttataacagtgacttgggcatcgccggattttggtatacttggggaatcctggaaccaaaccccagaggatacagagcaccaactgtagtaaaattcagccaggtagagaatggagagaagaagctccaagcagaggaaatgcctctagccttgctgcaggtgaatcagtccttttatctttaagaatcattttgccagccaggcgtggtggctcacgcctgtaatcccagcactttaggaggtcgaggcaggcagatcatgaggtcaggagaccgagaccatcctggccaacatggtgaaaccccgtctctactaaaattacgtaaattagctgggcgtggtggcgtgtgcctgtaatcccagctactcaggaggctgaggcaggggaattgcttgaaccagggagttggaggttgcagtgagtcgacattgtgccactgcattccagcctggtgacagagcaagattccttctcaaaaaaaaaaaaatcattttgccatctttgtccatcattttgaccacatcacccattcatttatttgtttatccatcacacaaatacttacttctaccagaaactcttctaggcactggagatacggcagggaacgcagagctcccatcctagtgcaccctcaggtaaacacggtgtctcactgcaggctctgtctcaaagctttgcacgaggccatgctcatctttttcttcaattatttgatatcgcaagctgactatccacaacaactccccaatcccttaggctgattgtgcaacatctcaccttgcttacttatttatttcttttcttttgaaatgaaatttcactctatcaccctggatagagtgaagtgcagtggcgtgatctcgctcactgcaacatccacctcccaggtctaagcaattttcctgcctcagcctcccaagcagctgggattataggcacccaccaccacacctggctaatttttgtatttttaggagagacagggctcactacaacctccacctcccaggtctaagcaattttcctgcctcagcctccggagcagctgggattataggcacccaccaccacgcccggctaatttttgtatttttaggagagacagggctcactgcaacctccacctcccaggtctaagcaattctcccctctcagcctcctgagtagctaggattacaggcactcaccaccacacccggctaatttttgcgtttttagtagagacaggatttcaccatgttggccaggctgttaactcctgacctcaagtgacccacccacctcagcctcccaaagtgctaggattacaggcatgagcctctgtgcccagtgtatttacttatttcatttaaaaaatcattccctgtttatcctaacgctggaatcaccagcactgataattctgctgttttctctttaaaccataaacacctcaagatcaatgatcacattgaactcagtatgtatgtgactaaaataaggccttatgatagaaaaacatactcaggccaggtgcagtggctcagactataatcccagcactttcagaagtggaggcgggtggatcatctgaggtcaggagtttgagatcagcctggtcaacatggcgaaaccctgactctactaaaaatacaaaaattagctgggcatggtggcgcatgcctgtagtcccagctactcgggatgctgaggtaggagaatagcttgagccctggaggcggaggttgcagtgagctgagatcacaccactgcactacagcctgggcagcagagcgagaccccagctcaaaaaaaaaaaaaaaaaaaagagaaacatactcaatttgagcaataataaagtttttctttctgaagaccttcagaaatatcaagaactcctatagtgagcctcaaatgcagtatgggaagagtgttatctttgaaccacccaaccttgggtgtgagttctgatcccacagtggactggccatggggtcttgagcaggtcctctacaagcctattttttttttttttttgagacagagtttcattcttgttacccagactggagtgcaatggcgtgatctcggctcaacgcaacctctgcctcctgggtcctggttcaagcatttctcctgcctcagcctcctgagtagctgggattacaggaacacaccaccatgcccagctaatttttgtatttttagtagagacggggtttcaccatgttggccaggctggtctcgaactcctgacctcgtgatccgcctgcctcggcctcccaaagtgctgggattacaggcatgaaccaccacacccagcccaagcctaatttttttatcatctgaaaagtcagggtaatgatctccatattgcagagcagctatatcagcaatgatagatgtcaaattcctggcccaggataggggccaatccctggtagttttttgcagacaacactcaagtcagtaagaagctctgggagctggagatcgggtaggagaggagactgaagctcttgttgggattcaactgatctagaagctgcacttatctctagtgtacctactgttcactttcatgaactactgagcagaacggacggtccaggaaattctacatgccctctgcctagattctgggtcttgctgctcaatcatgtatctgttgacttttgttgggggctttcacctttaggagcagcgctcttgatatggaaaacttcagaacggaagtaaatgtcctcccaggagcaaaggtgcagttcgaacttcactaccaggaggtgaagtggaggaagctgggctcctatgagcacaggatctatctgcaacctggacggctggccaaacacttagaggtaagcctggatctgtagggtgggcagtgacactgtccttttatagtctctgaccctgatttatactttctgcttgtcactagcacttgtggtgttggatgccactcaactctacaagacagtgggatgtattgaaaagatggtgggtttggagtcagccacaccacttccttatggctctcggtctccttagcagccgtattatggtggtttctgaggtctgctataacaagttacagcaaacgccacagcttaacacaacagaaattgattctctcatggaagtctgaagtcaaggtgtctgcagagctgcactctctctctctggaggctccaggggagagcccgttccttgcttctcctgctgtctggcagctgccagccttccttgacttgtggccttgtagtcagatcactccaatctcttcttccacggtcgcatcctctcctcctccgagcatcttaaatgcccctctgcctttctctcacaagaacacctattagatttggggtccaccaggtagtacaggatgatctcaactcaagatccttaattgcatctgcaaggactctttttccagataaatctacattcacaggttccagaggttgggcgcatctttagggggggaggccaccattcaacccaagacactaatcttcaaggaccagctatcctgagtcttcgctgtctcatctatgaaaagagtactgtaacagacttttgtttctcagttattttttttttaacttttaagttcaggggcatatgtgcaggtttgttacacaggtaaattccatgtcacaggggttgggtgtacagatgatttcaccacccaggtaatgagcatagtacctgataggtagttttccgatcctttctctcctccctccctcaccctcgagtaggccctggtgtcaactgttcctttctttgtgtccatgtgtactcaatgtttagctcctgcttagaagtgagaatgtgcagtacttggtttcctgttcctgtaatatgtggccaatgacaggagcttgatgaaggttaagtggattgtcttccctgccaccccagccatcatcaccgcaggggagcagtgcctcggtcatccactgcattactatccatctgaactcacctctgctgtcatcttcatctcttgctataaagactaaactgctcttttctttgctcaaatctttgtgacatcctatgactgtttagtgtaagaggcagagctaggcaagaggaaacctaagagagtacagaggccaacatgcccctcccccggcagatgggagagtaaagcagacaggttgtgaattgcccggagacacgggagatgaaagggaatgaattaatcacgatgaaactttaattcccatttgaaaagctgctcgtgggatcaataatgcccactgtttggcatcagttcactatcagagtctatgctgttgagttcttttctgggccactcctagcacataccgtgcttttgcgtgaattgaaaaaagatgcccgtccttcaggcaaatgcagcgccatccagggcacgtgacttggccaagatgctctgtacaattaagtgtgttgttggacatttttccactactgatgatggatgagtgtcagtaacccacattctcttcctcaatgccatgaatcccgtggtaaataatttgaagcaatggttagatgtgattagcatctaagcctaggaggagacaatcactgagactgttgataataacaatattaataaaaactgagtgacagcctgggcagcacagcgatacctcacctctactgaaaataaataaataaattagccaggcatggtggtgctcccctgtagtcccacccacttgggaggctgaggcaggaggataacttgagcctaaaaaatcgaggctgcagttagctatgatcatgccactgcactccaggctggatggcaaaatgagaccctgtctcaaaaaaaaaaaaaaaaaaaaaaagaaagaaagaaaagaaaaaatagcagctaagtaactcagaaacagaaaatcaaataccacaggttctcacttataagagagagctgaataatgtgtacacggggacatagggtggggaatgatagacattggagactcgaaagtgtgggagggtgggagtggggagacttgggagaagtgtgggagggtgggagtggggagacttgggagaagtgtgggagggtgggagtggggagacttgggagaagtgtgggagggtgggagtggggagacttgggagaagtgtgggagggtgggagtggggagacttgggagaagtgtgggagggtgggagtggggagacttgggagaagtgtgggagggtgggagtggggtgagggatgagaaattactcaacgggtacaaggtacattacttgggtggtagttgcactaaaagcctgggcttcatccctgtgcaatatattcatgtaaccaaactgcatttgtactccttaaatttatacagatttttcaaaataattacacaaaaatataaacaaacaaatcatagaattaaatttaaaaaagaaaaaaatggcagctatgactgtggtttggtcaagaatcaccaaaggggatttccctagatgaggtctgttcaaagcaagaagacagagaagaaataaaacaacccaagatttggggaaaatggtctacttttgacaggtctacagagtagatgcagtgctatttaacaatgagggaaaaagaagaaggaattctttttttccctaacaatgcaaatgctcttataaataaaaagactcgaatagaatgaggaagggagtcgactcctgggggagtgaggcagcagaaggagagctctgagtcgacagaagggggttaagcctccgtggtgagatgaatcccatcgcaggaacttgcagatcctgcaggagagatcgtggagtcgtgcccgggaaacctgcggaggagaaaagcatcagaggacttatttgtaattttacttcttgcttaaaaagactttaaagacttttaatgctttgggtaattttctcttgcatctctaggtagatgtgtgggttatcgaaccacagggactgagatttcttcatgttcccgacacatttgaaggccatttcgatggtgttccggtcatttctaaaggacaacagaaggtaccctgagccctgtgtgttgccaggcattcacagggcctctggattgtgggttctgttctccttctgtgctctggagaagagaaaagcaggctggtgttgaggacactgttgaagaaatggggatccccaagtagagcctagggcctccccaggatacacagaacaacactcccagtgctttccttccattttgaccagagattgtccctttttgagtctcatttccccgtcagtcacctgcttaaccagtagctaaaggacagctttcacatcctatatggcagattttcattcattaaccatagcaagacatgttcagctctctgcctcaatgaccagcgataaccaactatgactcctgtaaggagaaactcctctaagagcattaaaacatttcacaaactctttccaaagcacatagtcagcccttctacaggggatgaaggaaattcttcggctttcttctaaaaaggtctgaaaccttgcaaacagcatggcaggctagagatgctccctgcaaaagccctggcatgtccttcccatcagtaatgggtccaccgatatcgcggggattcagaacgtccattgggcagctcctcttccctgtgtgctggagaaggggcagcgccaagcactgggaaggggctagaggcagaggctctgatgtcaccgttctttctaggcgcacgtctccttcaagcccacggtagcacagcagagaatatgccctaactgccgggagactgcggtagatggggaactggtggtgctgtatgacgtgaaaagagaagagaaggctggtgaactggaggtgagtgcacaccggctctggttctactgccaagctcgtgccaaagagctgctcctttttgaacaaactcccaggcctatgggtggtttctagctgccagggcaagtgtttctagctgcagagaagggactaaaatcatattctttgaatataccgctaagcattatcttttatgtattaaaaactaaatgaatagggtctcatgctcttgtcccaggagggcattcctgggcctcatgtgaagaacaaaggaataattacagaacaggaattttaaataggctcccaaggccctttgcaattagacaatcaaagaaagcacagagattacggggtgaggaggaaggcgcatccacagcctagaaagatcaagagccagcggtgaatttcaaggccaaggtttatcatgaagtttcttgaaaagtttcctttccccttcagtcatgtcccagacgtgtgtcttcctttctttgtactaaggtgaggactcttagaacgtacgcaaactccaagagtctctctagggacagcaagcggagcacacaccctgtacctggatgctgtagtttcctggaaagaggcagccaaagggcagaggaaagagaattaggtgagccagtcatcaagcctgcagcagaagacaaagaggatggtcaggagtccagctggggcagcctctcattaacttcaagaaaaatccaaattttctaaagtggcccatacacgtccttcgtgatctgtcttgctgattctccaactagttccctgaattcttggattctacggccccatcttgctgaaccacatatggagccccaaatatgccatgttttctcatctctggggctgcgctgtctggaactctcttccccattccccactatctcaacctggcccagctctcaagagagcttctgagtctgagctcatccttaggtcccagtggagatgctgcttcctagagaaccgtcccctgggtgcgcgttagatgcacacggggctcttgccgagccctttacttcctaatcatggtgttgaacacaccgcgctgcacattgcctccacttacccttatcctctgctggctgggagcctcctgacgggaggtgctctgcctgattcaccgctggttagcagggcgcctggaacaggggctctctgtaaagactgagtgatgtggagtggagtggagtggagtgaagtggcgtggagtggagtggcgtgaagtcgggtggagtggagtggcgtgcagtggagtggggtgaagtgaagtggcatggagtggagtggagcagcgtggcgtggagtggagtagagtggagtggcgtggtgtggtgtggagcggagtgccctggcatggcgtggagtggcgtggcgtggagtggtgtgacgtggagtggagtggcatggtgtggagaggagtcaagtggagtggagcggtgtggagtgaagcagcgtggagtggagtggagcggaatgttctgctaggaaggtcttgaccctcagaggagaggaggtgggggagcaggcaggaaaatgtggaggcaaatgcacatcaagctccgcctcctcctccctgtagacccctctcttctctgagtccccaggtccccatcttcctaccttctaaacacgaatcatgatttgactcacaaataccttctatttttcaggtgtttaatggatattttgtccacttctttgctcctgacaacctggacccaattcccaaaaacatcctctttgtcatcgatgtgagtggctccatgtggggagttaaaatgaaacaagtaagtacccccttgtttgcagtggttggggggattccctatcttctttgatcccctcctaaaaatgcaatcattctatccctcctccctgcttagggctgaagctcagggactgtggttacagactgccggtgtcaactcttcctaaaattttgctattattgcatttcacaggacatacacctccgtcttctaatcattcctctagtgtaaaattcccttccttctcttcttcctctttcctgtttcctcttccttctctttctcttttccactctctatccaatatttccttgaaaaactgtctcaaaactcacctctttgaaaaacagaatctctatataacctcttctttcaaggatcagtcacattctttttgctcttccacatgttttattataatatcttgtcattgtccacatatgactattgattcaatatatacatattatttctaattatatggtaattgcttgagagcagctatccatcttatgttttccagctcagagctcaatataggcttacttagtgataagtgagatgtacagatgcaatactaaagaccaaacaaggaaatgatttaacttacccatcaatccatccatccattcaaccaagttgaacaaccaactaaccagtcatagggcaactatttttgaccacccaagagttcactactaccctaagatctgtaaggaacctaaaagaagtccctgtcagccaggcacagtggctcacgcctgtaatcccagtactttgggaggccaaggcaggtggatcacctgaggttgggagtttgagaccagcctgaccaacatggagaaaccctgtctctactaaaaatacaaaattagccaggcgtggtggtgcatgcctgtaatcccagctactcgggaggctgaggcaggagaattgcttgaacccaggaagcgggagttgcagcgagcagagatcgcgccattgcactccagcctgggcaacaagagcgaaactccatctcaaaaaaaaaaaaaaaaagaagaggaagaagacgaagacgaagaagaggaaaaagaagaccctgtctttcacagaccctgcctgcctgggtctgtactcccaggcagggtttctcagcagtgggactattgatattttggatggggtcattccttgttgtaggagggctgtctggtgcattgcaggatacttagcagcatggtctatggtctatttgctaaattttggtagcacaacctcccctgcatcataacaatcaaatataacgtcagacattgccaaatgtccgctggggggaataattgcctctggttgagaaacattgctctaatacaacagtttattcactgcttccttccttccatcactcattcatttaacaaatatttacgaagcacctactatgtgtcatacacttagttcatctatgagcaaaacagacccaaagcataaaaacagaaaccaaacaaaaaacagaaaaaaaacggatgcctaccctctgtgtgcttatgaaacttacatctgagggataggggacagagaataaacaatacacatgcaagtacaaatgtacaagtacgttcaatggcagcattttgataaaagtttttttaaaaaataaaagaagcatatgttaaaaaccaagagtggcaattgcaggggtatgcaattttaaataggcttgtcatctaaataggtggtttcctggagaagacctctgaggagaccctgagaaggtgaagggagagttgtgcagatatctaagggaattaaatgcaatgaacagctcatgcaacagttctaagtcgaaagtgtgcaaagaacagagagagatgccagtagagaggggcagtgggagatgagatctgagaagtgagaggcaaggtggctcatggaacacctgtgcagtcatgatcagagctggattctggaatctgttttgaaggtagagtaaacagtatatcctgaagggctagctgtgaggcaagggaagaaaagagaagtgaaagatgccccaggacttagcctgagtgactagaaggatgaagtggccatccatgagttgacaaagacagaaatgtaatcagacattgcagggaatgtcccagtttggttttggatgcaaagtctgagatttctattaagtacccacgttggccatggaagcgtggtgttcaaaagtgagatgtggagacacacagttaggactccccagcatatagaaggtactgtcagcattgggactaggtgagaatgccgaggagtagatggacaagggagccaagatcagacaacagagcattccaatattgggaatttgggaagaagaggataattggtgatagagactaataaaaacaattagtaagtgggggagaaaaatcaagagagaatgaggccctggaagacaattgaggaatttgtgttcaggagggagatgagagcacttgccggtgcatgagaaatgaagatggacctttggatttagtgacattagcatcattggtgaccttgacaagggcagtttcagtagagtgacagggatgaaaacccgaaaggattgggcttatgagagaataggaagagaagatttggagacagtgtgtttagacaattcctcaaggaattttattgcagaagaaagctgagaaatgaagaaagtggatgcacatgaggtttgtagaagggtgagaaataacatgtttttgttgatggaaatgtaccaatagaatagggaaattgaagaggcaaaggacaattgctggagccatgatctttagtcaaagagagggaatgaaatagttcatgaatagatgggtttgcattaggtagaaatactgctagttgttctttattatcaggtaggaaagaaaaatgtatgggtacaaatattgatggttgggattttatggtagtgggagtctgtgggaatgttcttctgtctgctgcagtttctcagtggagttggaatcaaaatcatcacacgtaagctagagaaagagggtgatggtggtggtttaaagagaaagatgaggaaatagtttaagagactgggtgagtagatggacttgagaaatgtattttattttcaggcatcataaaggtggcactcgaagtttgtgatccttaacataaagactagtcaaactggttgtgcatagcaaaatagatagtaaaattatcaaaaagccaacagtacatgcccagaataaataaggggcaggtctgcattgactgaggtgggctcaagaggttttctggaagaagtttagcttgagaagaacttgaaagatgaccaggatcaatgattggtcttcctagttcctctgaggctcagattttctgtaatgggacctgtctttattctctattgaaatagactgtggaagcaatgaagaccatattggatgacctcagagcagaagaccatttctctgtgattgatttcaaccagaacattcgaacttggagaaatgatttaatttcagctacaaaaacacaggttgcagatgccaagaggtatattgagaaaatccagcccagtggaggtgagtgtgttgggctaaatcccaaggagacacttcctctgggttcaaatcatgattcacttaagaagcattattcccatcacagtggtctttccccagcattcgagggcctatcttaaataatacatttattggtaatggatgaatgctaagtttgtagtgaaagtagaatttgtaatacagcccacataagctttgaaccgttttaatgtctctcagaaaaaggttcagtgacactggccttctttattgcctgcataaagcataaaatgttactatcttcagagtatcttggcaaggctgatttggatactttaatctggtgtttaacaagctaacagtctgtgctttgaaagggctagttcatctctaaggggatagtttatttcaaagtgaatatttcactgcactgggggaccaccagcttgagcacagtttgtgtcactcagaaagcaatgaaatgattttggcatggaataagtgatggataagtgatcagccgacatatgagtctgaatccagaatgggattttctgcgtgtggcgagaacgcatacccaacgtttcattatgctacttcaacaggcacaaacatcaacgaagcactcctacgggcaatcttcattttgaatgaagccaataacttgggactgttagaccccaactccgtctcgctgatcattttggtttctgatggagatccaacagtgggcaagtgtcacttcaaccttctcacgacaaacactttcactgttgtttcttggaatggtggtttgcctaaaaggggaactctaatggcatttgcctgagtttctagaacattttaaacccatgcttcctaaaggaggtcttctgatcctgcagccctcaccccttaagctactgctcagacactttcagcaagggcgctcttgaatgcctcagttccacctccacaatatgcagaaatctgagtctgaattttaatagtatgttgtgaggattgctgatgcattctagggaaatgcatctatttcctcaacttgaggtatgtgaagatggtgtatgggggtggtgaatgatgagtattgatcccagatctcccagcagtacctttggaggccacagtagcatattccctattattctccacacttctcccggttgcacctggagaaatgactgctctctgacacaaccttgaagttaaacatttttctttctacaaaatgggcagcaacatctccctacttctattatttatttttatttttgttacattagtttattttatttatttttgaagacagggtcttgctctgtcacccaggagggagtgcagtggagcacacacagctcactgcagcctcaacctcccatgctcaagtgatcctcctacctcagcctcctgagtagctgggactacaggtgtgcaccaccacactcagctaatttcttttttttctttctttttttttttggagagacgaagtctcactatgttgctcaggctgatctcaaaatcctgggctcaagcagtcctcccacctcggactcccaaaatgttgagattacaggtgtgagccactgtgccaagctatctttgttttacttgtgtctttattctggccactgtaagtaatagcgaatgccagattgtgttgcctgagtgtgctgtcgtacagactaggaccgagtctaacacgtcctgacacagccaagcagaatgaaaatgcacgaggcaaaaacaatggcagtcagagctttagaaagccagagagcaaccatcttattaataacgagactagaatgagccagtgttatgtatttgttgtagagccaatgttttctccctcagatcagattattttcaaaattcaagttttgaatgaaatcataaggtggaaaaggaaatatagtttaaaatattaaacttgccaggcatggtggctcacacctgtaatcccagcactttgggaggctgaggtgggtggatcacctgaggtcaggaattcaagaccagcctggccaacatggtgaaaccccatctctactaaaaatacaaaattagcctgacagggcggcgtgtgcctgtaatcccagctattcgggaggctgagacaggagaatcccttgaacccaggaggcggaggttgcagtgagctgagatcgtgccactgcactccagcctgggcaacaaagtgagactctgtctcaaaaaaaaaaacaaaattaaaccataatttggtttaatcatggtttctcactcctgtttctcaaccattcagttcctgtccctggaatcagtcactggttaccagtttcttgtgtatctttccacaaatagtttatgcatgcctgtatactatatatacatgtttgcacacatgtatgtgtatatgcatacatacacatacatacatttatacatgcatgcatgcaaatgcatcctaggtaccctgatatttaccttgttttttttttctcctctaaacatgcccttgagattgtctggtatacatacataaggagtttccatgtcctttttaatagctgcatagtatctcacggtttaaatgtatcatcatctaaccaagcgccctcattggtgcatatttatgttgtttccaatatgttgctaattcccaaataatgttgctatgcaacacaacccacacttcatttcaacatgtacgagtgcatctctaagaaaaactagaaattgagttactgggtcaaaagggaaatgcagttttaatctggacacactttactaaactgccctccctggattttccagaaaatttatgatattgcttcttcattcctttcctttcggacatcaccaactttaggcgaactaaaactgtcaaaaattcagaaaaacgttaaggagaacatccaagacaatatctccttgttcagtttgggcatgggatttgatgtggactatgattttttgaagagactgtccaatgaaaaccatggaattgcacaaaggatttatggaaaccaggacacgtcttcccagcttaaggtaacattttcttctgttctttttttattcttcactggaaatcatttaactacccatatctgatgcaggtatgatgcataactgaacttaactcaaaatggtcatgatctcagccatatttggttgcaaggatcagggaagtgcccagttcctttctcacatgtttccccccaccctcatatttctgcagtaacagtgaggtatgaggcagatgggtgttgggaacagctgtcctaccccctgaacaaaaaggccttctgagcgtcatcaaagctccttgtagctctcctgccccaccagcaattggtcttcttatcatcatggccaaccgttttctctttaacgtgcattggcatcttggtatcaatttttcacagtgtaaattttcttaagtattaagatacaggctgagtgtggtggctcatgcctgtaatcccagctctttggaggccaaggtgggaggatcactcgagcccagaggtttaaggccagcttgggcaacatagtgagatccatctgttcaacagataatttttttaattaaaatacatatattgaaaagacacaaactacttgtttgttttgattaaatagatgagaaaatgatgtagggaaagaacatgtttttccctgctctttgtcagtaccaggcatcgtatttaaatttgggaacaagtaagagataagattctgatttggggactattaacccagctgacttttgtaaaaatttaattattactattattttttgagacagagtcttgctttgtcacccaggctgggtgacaagtacgttcaatggcagtgcaatggtgtggtgcagtggttcaggagtgcagtgctgcgatctcggctcactgcaacctccgcctcctgggttcaggcgattctcgcacctcagtctcctgagtagccaggattacaggcatgtgccaccaggcccggctaatttttgtatttttagaagagacagggtttaccatgttggcgaggctggtctcaaactcctgaactcaggtgatccgcctgccttggcctcccaaagtgctgggattacaggtcaagccaccatgcccgacctcctgctgacttttatcataagtttgtccaagagtttttcacgctgaccgtaacagaaagggaaaaaaatgccaggctcttaaaccaaaggtaatgttctcaacaagtctttgtcttctctctgtttttaatctgataattacgagcattttcccttgtcccaaacgtcctgtgtgaataaattaagaggtatctgctgattctttgaagaatctcagagtaaaatgttttagatcagctgggcgtaatccctgtaatcccagcactttgggaggcccaggcaggcagatcacaagacagaagttcaagaccagcctggccaagatggtgaaaacccgtctctactaaaaatacaaaaattagccgggcttggtggcgggtgcccgtaatcccagctacttgtggggctgaggtgggataattgcttgaacccaggagccggagattgcagtgagacgagatcccaccactgcactccagcctgggcaacagagtgagacatcgtctcaaaataaataaataaataaaataaaatgctttagatctacaaagcagtaggaacataatttctctctctctctctgtgaattgtagaaattctacaaccaggtctccactccattgctccggaatgttcagttcaactatccccatacatcagtcacggacgtcactcaaaacaatttccataactactttggaggctcagagattgtggtggcaggaaaatttgaccctgctaaattggatcaaatagagagcgttatcacggcgacttcggtacttccacttatccatttattctatctactaactgaccccctagatacagtccctcttgaatgtcagctctgcctgcctggaatcatgggtgtagaacagaagcaatcagtgatggagaaggcatgagaatatctctgccatcttcccagctattccataaatcctgaccttttcacccaagcccaatcccaagcacaggaatgcatttccttcctccgtaggctttgccttccatttcttttttattcccattcattcgcagcaggtactaaaaatgtgaatcaatgaactataattctgttacccagtgtctctcaactgaaccttccatcatctaggctaacacgcagttagtcttggagaccctggcccagatggacgacttgcaggattttctatcgaaagacaagcatgcagatcccgatttcaccaggaaactgtgggcctatctaaccatcaaccaactgctagctgaacggtaagaagagaagagtacccacaccacgagatctgcaaaactgaaatgtccaccgtgaatatatgaagtcatacacaaaaagagtttggaagcaagaaagacagcacattagcacaggcttggattattaccttccactagttctgaacacttcagagaaagctgggttcactctttttcttctttattgaggtataacatacagtaaagtatgcaaaatgcattaattttttaatttttattttatttatttatttttattttttttgaggcagagtctcgctctgtctcccaggctggagtgcagtgacgccatctcagctcactgcaagctccgcctcccgggttcacaccattctcctgcctcagcctcctgagtagctgggattactggtgcccaccaccacgcccagctaatttttttgtattttagtagagacggggtttcaccatgttagccaggatggtctcggtctcctgacctcgtgatccacccgagtgggcctcccaaagtactgggattacaggcatgagccaccgcacccggccaaaatgcattaattttaagtgcaccattcaatggatttttatatctatcatccgtgtaatcaccacccagatccagatgtaggttcccttgttctccctcaacacccacccccctcctccactgtaaccactctttcaatgtctgtgatcatcagttttgcctgatcctaaatttcacataatcatgcaatctgtattcctctgttcctggcttctttcactcaatatgatgttggtgagattcatccatgttgcttcatgtatcaggcatgtatttgcatttactgtctcgatctcctgacctcatgacccgcctgcctcggcttcctaatgtgctgggattacaggcatgagccactgcacccagccctgcatttactcttgaaaatggcttcttgtccaaagagaaattgatgattattaacgattatggtgttccctaaggaagggctcccctatgctcatctatgtcccctctggttgcttcatgtatcagtaatttatttgcatttactcttgaaaacggcttcttgtccaaagagaatttaatgattatgtgattatgatgttccctaaggaagggctcccccatgctcatccatggcccctctgacttctcagctgagctgcatctcaactctccaacatgaaaactatatccccagagcaatggatggttgaccacctgcatcaaaattacacagaggtgtttgataaaagttcccattcccaagcctcattctgtctataagacaggattctcaggaaggtggaacagggtctaaatgaggctgggaaaatgaaatgcagttgtatgactgaactcatagagaaaatccctgatgtcaataaggttagaagaaatacgcaaggctgtaaactatgactgtgaagtaaacgagaaatagctccctctctgacagaagcacactagatgtatttacaggtatatagcaaattgttgcagaagttaaatattgattttaaaacaattcctataaaaagatcagcagttgctaaaggttggggagtgggagatacgtgagtaggtggagcacagagcatttttatggcagtgaaaataccctatatgatactccaatggtggacacctgtcattatgcatttaaccaaacccatagaatgtacaacaccaagggtcagccacgttaactgtggactctgcgtgataatgatgtgtcagcttcttccattgtaacaaatgcaccactctgatgtgggatggatgttgatagtggggaaggccgtgtatatgggggaccgtgtgtatgcagtggagacatagaaaatcttgataccttctgcataattttactgtgaacctaaaactgctctaaagtataaagttttaaaaaaatgccttgggagccagatgcatggctcatgcctgtaatcccagcactttgggaggccaaggcgtgtggatcgcttgagtccaagagtttgagaccagcctgggcaacatggcaaaagcccatctctacaaaaaatacaagaattagtagggtgtggtggcatgtgcctgtagtctcagctactcaggaggctgagggaggaggatctcttgagcccaggaggttgaggctgcagagaaccgtgattgtgccactgcactccagcctgggcaacagggcgagaccttgtctcaaaaataataatgataataaataagtaaataaataatgccttgggacttagccagataaaatactcagcttctcgaagccagtgagttctgtttcccagttactttgcggctccgccccacccccaggttggaccccagcagtggtggggtgcagggtcagggagctgacttgcgctccccctccaatgcagccatgctccataacacctctacttcttgaatacagaagcctggctcctacagctgccgccaagagaagaattacaagatcgatcctgcagatgtctctagaccaccacattgtgactccgctgacctcgctggtgatcgagaacgaggctggggatgagcgcatgctggcggatgccccaccgcaggatccctcctgctgctcaggtcagggctgcacctgtggggacaagtggccaggcagctctcttgccccgggggtgggcgaagtcctagtgcctccgctctctcccaccccagcccacctcttgctcccagccctgggccctcctgtgcccaagctcttcctgccagctgggaggaggatggattattgctgtggtcgttgaccattttgctcacaagtttcccaaaggaacttttgaaaacctgcgtaccccttccaacatttttgacatcaatatttgaaattttttatcttagcctgggcaacatagcgagaccccatctctaaagaaaagttttttttcattagctgggtgtgatggtgggcacctgtaatctcacctgtttggaaagctgaggcaggaggatctctcgagcccaggaggaccactgcactcccgcctcctgggggtgccatcacatctcactgcaacctccaattcctggacaacaaatacaatttctatatgcaactaacataatcatagtattttataaatattgaccttttaaaataaaactgtcacatcactgttttctttttcttttcttttcttttcttttcttttttttttttttttgagacagagtcttgctctgtttaccaggctggagcacaatggcacgatctcagctccctgcaacctcagcctcccaggttcaagcaattctcctgcttcagcctcccaagtagctgggattacaggcatgtgccaccacgcccagctaattttttgtattttagtagagacggggttttaccatgttggccaggctggtctcgaactcctgacctcaggcgatccacttgccttggcctcccaaagtgctggggttacaggcgtgagccaccgtgcctgaccatatcactgttttcaatacatctaataaaacagaatacttaattggttactcactatcactcatttttaaaaaatacataagcaaatcctatattacaattactagaacctggccagtcatggtggctcatgcctataatcccagcactttgggaggctggagtgggttaattgcttgagcctatgaacatgagacgagcctggtcaacatagcaaaaccccatctttagaaaaaaatactaaaattagccagccatggtggcacatgcccatagtcccaaatactcaggaggctgaggcgggaggattgcttgagcctggaaggtgaaggttgcagtgagccaatcacaccactgcactccagcctgagtaacagaataagaccttgtctcgaaaaaaaattattggaagttttatattattcttttttctagttgaacttgtatttccactccacttgcccagcagaactatatcctattgtaatatatttttatgcttattttagtaatcacctcacttatctataagaaaaaaagtttatacattttaattttaattaagaatttaatttaaaaatcataaccataagattctgagtattcaaaattcccttctgaacctggtctgattaatattactactagtagccaagtgagcaaaataatataaatagattataaatttgtttacaaataagaagtaaaactggagtggaaataatctataatctcttactgggaaaaatgtgactgtttttcatgtattcatgggtaagtattatttacgaatggattgaaagagacaggattcggcatcaattctacttttaagagaacttgtatgggcagaagtcctgataaatattggttggtatagacaagtggatagaaatggcaagtgtctggttatattcagttactcgcttatctgaactctttcatattatatgccaaaacatgcatacagacctagcgtccaaaaaattttgtataatttatcagctgacaatgtgagcccttcttcaattttgttgaaagcaaagaattggaagccctgtggtttgtacaagcacttgctcccaatcattggaatcaggtttcttgccctacaccagtattccaatggatgttttgcttcctggaggactctgggggaggggagtagacaagaactggccttctgcttgtaaactaggagaaaaggctttctttaggaacgagtctgtgtctaaactgagactctagaaattgcctttcaaacagtccatgctctctgagtcctgcagaaagtatccaggcacccccgagggtgcacacacccagggctaggagacctcaggtttatacgtctctttcttttctctttcttggggactggttctaccgaaacatatatacatatatgatatatacacacacgtgtatatatctcatatatatatatatatatatacacgtgtatatatatatataacagataacgtataattataattatattatctgtaatatataattatatatattttgtattctatatattatatactatgtattctatataatatatattatgtattctatataatattatatattaaattctatattctatattatattctatattctatagaatattctatattatattctatattctatagaatattctatattatattctatattatattctatattttctatattatattctatataatattctatattatattctatataatattctatattatattctatataatattctatattatattctatataatattctatattatattctatataatattctatattatattctatataatattctatattatattctatatattatatattatattctatatattatatattatattctatatattatatattatattctatatattatatattatattctatatattatatattatattctatatattatatattatattctatatattatatattatattctatatattatatattatattctatatattatatattatattctatatattatatattatattctatatattatatattatattctatatattatatattatattctatatattatatattatattctatatattatatattatattctatatattatatattatattctatatattatatattatattctatatattatatattatattctataaaatattatatattatattctatataatattatatattatattctatataatattatatattatattctatataatattatatattatattctatataatattatatattatattctgggccttctcccagacttcgctccccggcctgcactggagtcacggggcccttccccggccctataaagcggttcctcccactgccacccttgctcaggttccagactccagagagaactgtatcacaggcctcctccctcagcaacatgacagagggagcccgagagaactctggaataaaaacagaggagaaaaacctaagctgacaatacctgggggtgcataaaacagattcttgacatggtgagcaatttccgtggaaacgtaaatctagaaactaacagatgcaggtttgtctacgcaggggccctgtattacggcagcaaagtggttccagattccaccccgtcttgggccaatccttcaccaacgcccgtgatctccatgctggcacaaggatctcaggtgctagagtccacgccacccccacatgtgatgagaggtaacgcttctacactgcttgcacgtcccagaactcagccgaccataatcctgggaagcattgtgtgcatgaggccaggtgcagcggctcacgcctgtaatcgcagcactttgggaggccaaggcaggcagatcacctgtttttctatagaaatacagcttattttgtttgtttttaatcatgtatttacagaatcctagttttgttcagtctttaaaaaaacctttctgcaaacagtttcagtgggaggtttgggtagtagctgtggtcatgccaggaaaatgtatttctttgtgagagttttggtggctgtggcttccttgtgtagtcgcagacttctttgccctccgttgtcaatttctttgcctttccattgacaacctctctggcatcttctcccacagcatgtgagacggggagctgccccggggaaatgggagggagagcgtctcctctcctgttcccagctccttgcgttgcagccttcacccacagagatcacagctgctggcagttagctagttcatctagaaaacctgtgtgcagcttttctttccttactttccttttgattagaaaaaagtaaatttcaacattcaaagacagagcacatccctctccctgaaggaaggtgcaaagtcccagcctgacttgagtgtttgaaatttagaagggtggctcctgttggtcctagaattgtgcggctttcttgactgcctggaatacagacctttccatcaggaaagcctcaaagctggttctccaggttgtatgcctagcacataccaaataccatgttgtagcagagaaaacttagcaaggactttgaatggacatttaatgttatttcaggcaaggcccatggctcacacttgtaatcccagcacttttggaggctcaggtgggagaggattgcttgaggccaggagtttgagaccagcaaaaaaaacaaaaacaaaaacaaaaaaacccttttcaaaaaattagccaggcatagtggtgcacctgtagtcccagctactcaagaggttgaggtgggaggtttgcctgagcccagaagttcaacgttgcagtgagctatcattgcgccactacattccagcctgggtgacagagggagaccctgtttcaaaaaataaagtagggaccgggcacggtggcttacgcctgtaatcccagcactttgggaggccgaggagggcagatcacttgaggtcaggagttcgaatccagcctggccaacagggggaaaccctgtctgtactgaaaatacaaaaattagccgggcatggtggcaggtgcctgtaatcccagctactcgggaggcttaggcaggagaattgcttgcacctgggaggcggaggttgtagtgagctgagatcatgccactgcactccagcctgggcgacagagcaagactctgtctcaaaataaaataggataagataaaacagggtgataaaatagtaacttcatctcacccttagggcttatctctaaaattattattttggggccacaagtaacttgctccttcacctccattgctggtagcactttgtacaacactcccgtctcctaccccagctccatagggagtcccacgaaccatgcagaagtctcagttaacagcggcaaacgtctgcagccatgcatgagtggggaatccgtgcgtaagttgatcatgctggaggagcagttgcttttactgtgcctttctgaccagcagtttctgagagccagacactaccatgacgcccagggagtgagctgcttaaactgtggctttgcaaaataaagcttttggagaaaattgttgagatcaagttaatttacttttaaatattcttcccatttaagactgtagtgcttcttccaagtttctcttctctgttgtatgatgtagtgaaaaggatgaggacttcaaagttagacagtcctggagacacatctgccccatgaccttgtccatacactgaaatctccctagggctcaagcagcccacctctaaaacggggatgataataccctccctgcagggtggatacaagtttctccttcctagtagaagctgttatcactgaccagtgttctgcccatgaacctcaggtgctaggaatctataacattagtcacggaggtccttgatctactttctgcctgatcaaaatgtcaagctgtgctgactcatttaaacatgatgcttcgtttctgttgtcttgaattatgtcaactcaatatggcagcacagattcactgttgcctatcagaaggtctgattggcgggatttgagctaattaaatggcaaaaccaatcgttgtctttaataaaagcaattttcttcgaacagaatatttcaaactaccatatttgtgtagaggaagaaagaggatatcataatgattgtttaaggttttttttttttttttttttttgagacagagtttcactctttttgcctaggctggagtgcaatggctcgatctcggctcactgcaacctctgcctcccgggttcaagcaattctcctgcctcaggctccagagtagctgggattactggtgcccgccaccacacccggctaattttttgtatttttagtagaggcggggtttcactatgctggccaggctggtctcgaatgcctgacctcgtgatccacccgcctcagcctcccaaagtgctgggattacaggcgtgagccaccgcacctggcctgttctgtgtttttacaatgccctgtagtgtctggctccaagaacaatcaactaaccatgtatttgtggactgcagagcatgaacctggaggtgtgaactgaacatttctggcctgagtgactgctttagccactgcacaagcttcctgtaactcctctgcaaacttttagtaacactgccaccaacaactttcctaaaatgagggtcaagtcacatttattctcagaaacctttaatagctgctcaacagaataaaggcccattcttggtgtttcagggtctctgtgatctctacttttagctctttttctctgcattcttcaagaacctgtcctctggtcgcattgagttattttctaaagaaatcataaactcttctacctccactccttcctcattctgtacactcagaataaaatctcttcctccttagccttttgtctttccccgctgtcctctgaccttaaagacagttcagaagccacctcctccattcagccttgctgtttgcctggggggcactaatcattttcatcttcattctcacagcattttacttgagccactattgcaccatgtacttcattctatcttacattcgtgattatgtctgccccttgcactaaagtattactttcttgaagttactgaccatgacttatgtttatagttaacaccaaacattgccaaatttagtgattgcacatagattttttttttccttcaccaagtatttgttgaatggttaaatgggaaagagcgggagagggagagtggggatgggggagcgggaggggaggggaagcaaggaaggattatctaaaataattaggttcaataacaaaggagtactttcttgggagtagcttgattcttcattgcttttggaattgaatcatattaatctgtatgtcaacaataatagtgtgtctcctttgttttcctgcattgtatatggctccttaaaaaatatatctccaggctgggtgaggcggctcacacctttaatcccaggactttgagaggctgagatgggtggatcacttgagttcaggagtttgacactagcctgggaaacaaagtgagaccccccatctctacaaaaaatacaaaacattagctagacatggtggcacatggatgttgccccagctactcaggaggctgagctgggaggatgacttgagccttggaggtcaaggctgcagtgagccatgattgcaacattgcactccagcctgggtgacagagggagatcctgtctcaaaaaacacccaactctatttttctgtctacacacatattcacacacgtgtatgtatgtttcttatatttgtgggtgcatatttgtgtgtatttcttattccttaagtctttcttattcattttttatctctagtatctagtctagtgcatacatttttagctacaaaataaatatccactatatttgtaaaataacatagggttctgaagaaggctccgtgacaaagggacaatggagtatgaaccactgggtccccaagacctggaggagtaccgagcatgtaggagaagcacaataaatatttgttctgattaaattaaagatgttcaggaatgacatagtgctcaaaatcatcttccttttaatgattttgtttacgttttctttgtatattttccagttgaaaatgacccacatttcatcatttatctaccaaaaagccaaaagaacatttgtttcaatattgactcagaacctggaaaaatcctcaacctggtttctgacccagaatcaggtaaaataaaaataaattatatttgcaccaattaggtcattgtcatgctttcctgtcactgcctgggatttctttctttctcagcttaatagaagttctatatatttcagtgatattagtgagaaattaaattataaatatattcttaactattttgaaccattatagttcaaaatatatactctgagtatgaacttgcagatcttgttgtgatataattaatttaaatatgagccaggaacggtggcttacacatgcaatcccagcactttgggaggccgaggtgggcggatcatctgaggtcaagagttcgagaccagcctggtcaaaatgatgaaaccccaccccccactactaaaaatacaaaaacaattacccaggcgtggtggtacacacctgtaatcccagctactcaggaggctgaggcaggagaattgcttgaacccgggaggtggaggttgcagtgagccaagatcacaccattgcgctccagcctgagtgacagagtaagactccgtctcaaaaacaacaacaaaaaatttaaatactatatgatagtcaattatttaaattttataaactgacaattaaattttataactgatataaaattattaaattaaattttattaaaatttataaatgttatattaacatgttataaaatgagaatcacaaagaagaaaatgttaatgtaaatcttgaagcaaaattataataattttccaatattgccaagtttttataaatttgaattatagtacccacacatgcaaaataaatggcacagaagagaaaacatcatttttttctttcctgtaggaattgtagtcaacggtcagcttgttggtgccaagaagcccaacaatggaaaactaagcacctattttggaaaactgggattttatttccaaagtgaagacataaaaatagaaatcagcactgagaccatcaccctgagccatggttctagcacattctccttgtcctggtccgacacggctcaagtcacgaatcagaggcaagtatgattccatctgaacttgggcctgtccgtgacacacgactgcataaataaatccaggcatcagtgacatcaacattgaaaaaaaatcatcattttaaatataaggaagttgaggttcagaaaaattgttctcactccctactctgttcctggcagtgggcactgtgtgtttttggtcaccgttgggtcccaggacctagtccagtgcctggcatcagtaaacactcactgtgtatgtgctaatcagtgaacaaatccaccagctgaaatccatactgactctatcgcagagtgagctccaaacgccatgattgtgtcctctgcgtagaagcttcccaatgagtttctgttaatccatcatttatctataaactgttgcaagcgcttagataactagcggaattgtctgggaggagtgaagagttcatattaggggtgagaagaatgactttctcaaaaggtctgttctggaatggtttaattcctcttggactttcacaccagggtgcagatctcagtgaagaaagaaaaagtggtaactatcaccctggataaagagatgtccttttctgttttacttcatcgtgtttggaagaagcatcccgtcaatgttgactttctgggaatctacataccccctacaaacaagttctcacctaaagcccacggactaataggtaaagtgtctattgaccatctgacaagggtggggccgctctaattctttagcagctttggttgacagtggttacaagttgaggacatggcaggtgtggactcatgagcacagaggactaacatagcagtgtggggtcgctcgggaatgtgacagccaggaccttttgccattccagacaaggttgtccagggccaggatttcagcatcacaaactgggcaagttaagagaagggacagatacattttaagttttatgttaaagatttttttctaactgaagcaagatgaacccatttaggaggtctgtgataacaagcagaacactctggacaaatgtccctagtattttaagaagggctcaaatataaagcctgtgacatcacaaacaaaactttttcctgtgatctgagctatactctcaggtgctcacctcattctcctgccatcagggtgctcgatttacttacaatccactagaccaacctcatgtataaaatgaccatgagctccaggcatggtggctcgtgcctgtaatcccagcactttaggaggcctgggcaggtggatttgcttgtggagttcaagggcagcctgggcaccccatctctaccaaaaaattagaaaataaaaataattagcagggtatggtggagcctgcctggagtcccagctactcaggaagctgaggtgggatctcttgagccccggaattggaggctgcagtgagctatgactgtgccactgtgctccagcctgggtgacagagggagactccatctcttaaattaattaattcattaatttatgagatggagtttctctcttgttgcccaggctggagcgcagtggcgcaatctcggctcaccgcaaccgctgcctccccggttcatgcgattctcttccctcagcctcccgagtagctgggattacaggcatgcaccaccacgcccagctaattttgtatttttagtagagatggggtttctccatgttggtcaggctggtctcaaactcccaacctcaggtgatctgcccacctcggcctcccaaagtgctgggattacaggtgtgagccaccacacccggccccaaatcttaaatttaaaaaaaaaaaaaaaaaaaaaaaaaaaaaaaaggctgtgagtagtggctcacacctgtaatcccagcactttgggaggctgaggtgggtggatcgcttgagtccaggagttcaagatcaacctgtgcaacacggtgaaaccctgtctctacaaaaaattagccaggcgtagtggctcacgcctgtggtcccagctacttgggaggctgaggtgggaagaacacttgagcccaggaggtggaggttgcagtgagccgagatagcaccactgcactccagcctgggcaacagagggagatcctgcctcaaattaaaaaaataaaaataaaaaaaagatggtgagcagcacaaatgtgctcccaggaaggaccctccctcccatcaccactcctttttcctctcagcttgtctttccaccctagaaatcctggagggaggaccgaaaggtagcatggagtcaataatgagcctctttttatttaactatgattacatgtcaatcaatgtctgattctgttttgctaggccagttcatgcaggaaccaaagatacacatcttcaatgagagaccaggaaaggaccctgagaagccagaggccagcatggaagtgaaggggcagaagctgatcatcaccaggtaggcctcgggcgtaaggacagtgacgaaaaggccttgtgttagaattagacccacacagcaaaatagaggagcaaagaagaagtgtcgtaggcactacctacatcacactaagcagttcattaggaatagacgcacacagcattcgcataaggacacttctgatatcccacgttaaatgcaaataatgactgggtatctagggtcatgcaatgccaagattaactaacctgttgttctcatcttcatactttagaagccctcacaagagcttcacaagttggataaccagacacgttgatcaaaggagagaatcataaaacacctattaccatagtgctgcagaatgaatgtagatttttacatcaggctagagttttccttttgcacagggatctctgactgctttttttgtagcttttcttacacaaaccacccccatatgcttcatctgaagtgagaacttagacgctcataacgcattctgagtgtaaaagtcttacaaatcttgatattttttcccagtcctttacagttgtctcacccatgccaaatttgataccgttttaaagcagcttacccctttttagagtttttacaaagcagccaactttgctttattagaaaggattcttcacgcccacaaatgtcattggctttgacatacttaattaaaccataacattgtaacataaaattgtagtcggaagtattgccacgaaagtagatttgtgaactgaaacaatggattcttagtgaatatgccattcaattagtatcagtttatgggaggaatgaggtaccgacgggaatcagtgagcatgtgtcacagaagcaatggtgagcacaaattattaatgttaatagtaagttatctgaagttggtagaagggcatttactgccaggcatggtggctcatgcctgtaatcccaatgctttgagaggccaatgtgggaggatcacctgagaccaggagttcaagaccagcctgggcaacatagtaagactccatctctacaaaaataaaaataaatataaaaataattatccaggtgtagtagattctgcctatagccccagctactcaggaggctgaggtgggaggatccgttgaacccaggagttcgaggatgaagtgacttatgattgtgcctctgcactccagcttgggtaacagagagagacctgtctcataaataaatacataatatataaataggccaggcgcagtggctcacgcctgtaatcccagcactttgcaaggcctgggtgggtggataacctgaggtcaggagttcaagaccaacttgccaacatgttgaaaccccccccatctctactaaaaatacaaaaattagccgggtgtggtggcgggcgcctgtattcccagctactcgggaggctgaggtaggataatcacttgaacccggaaggcagaggttgcagtgagcagagatagcaccactgcactccagcctgactccatctcataaaatatgtatatatatttatatatacatatataaataaatatatgtatacatatatatatatatttactataatgacaaaaagtaaatgctgggcctcgatttggtccactgcaagcacctcatggttcataactgaaactgagctgtcccgtgggctgggcacagtgatacttttaagtctcgttcacgcagtgtgaacgagatccttaacaaattgttggctactttgcccttcaagtggaggacatgaatctgctcagaaacagcaggtatcactcttaaacacagagaaagtgcagttaagaggtgccgccaatgcattctttttttttttttttttttttttttttttttttttttagtgacagagtcttgctctgtcgcccaggctggagtgcagtgacgtatcttgggctcactgcaacctccacctcctgggttcaagcaattctcttgcctcagcctcccaagtagctgggactacaggcgtacaccaccatgcccaggtaatttttcttttaatttttagtagagacagggtttcaccatgttggccaggctggtcttgaactcctggcctcaagtggtccgcccacctcagcctcccaaagcgctgagattacaggcgtgagccaccatgcctggctgctgactcattctttaagtgacctgtgaggtcagcctcaacactgtggagtcttgttcctgccttctttccattggctactgtttccctcgctggaaaagcccatataggtcaactctaagggttctttgagttctccaaggacgcttcgctgattctctgtgcttccaacaccaagccccagacttggtgtttctttttcacatgacttggggagcagcgataggtggggggcggcagatgtggtgacagaaggaacacgaagaacagcaaggaaaagagggagtcttgtgtctagaggtgctcagtctccccctaaccacatgccttgcttccttgcaggggcttacagaaagactacagaacggatctagtgtttggaacggacgttacctgctggtttgtgcacaacagtggaaaaggattcattgacgggcattacaaggattacttcgtgcctcagctctacagctttctcaaacggccttaaaggtttatagtttgggaaattatatatattaatatacatctttcccctgtcacttttgcagatattcttcggtttgaataattaaaatgaaccagatatcagggtggttaattaaaatgaaccagatatcagggtggtttataaagcctgtaaacacacctaagaaaataaacattttacaaatgagcttttaggattttgttgcatttttagatgccgaagtgtgtggatcaaggtggtgccgagacaagccagcgtctggaagagccttaaatttggtgtttactgtgatcatttattaatatcttttctttcttttttttgagacagggtctcgctctgttgcccaggttggagtgcagtggcgtgatcatggctcacttcagcctcaagctgggcacaagcaatccacccacttcaacctccctagcagctgggactacagtcgcatgtcactatgcctggctaatttttgttttttgcagagatgaggtctcactatggtgcccaggctggtctcaaactcctgggctcaagtgattctcccgcctcagccgtccaaagtgctgggattacaggtgtgagccaccatgcccagctgatcatttcactgctgttgagtctcaggtcctcaaccttgcagatcgcgtccatttttacactgctagttacatgggaagtacaattatgagagggttatatggtgagcatagaacaagaaatgggggttacttgatcttaggtgcttcgtagagatttatactaaagccctgttaccctctgtagagatttatactaaagcaaggatagccttgctatggtgcctgtgatagcccagtatttttagccaagattctcttcatagtgttggtccctgggtcccttttgagtttatgaggcctggattagccatagttctccaggaaaacagaacccataggagatttacaataaggattggctcatgtgattatggaggcttgtaaatccaaaatctgcagagtaggctgatggtacaggagaactagggaggagccagtgttccagctcaaaagccatcaggcaggaagagctgatgctgcagatgaagttcgaaggccgtacactagagaatcccccgactttgggaagtcagcatttttgttctattcaggcctttgactattagacgaggcccacccacacaagggagggtgatttgctttacttttttttttttcttgagatggggtctccctttgttgcccaggctggagcacagtggcacaatctcggctcactgcaacctccacctcccgggttcaagcgatcctcctgcctcagcctcccaagtagctgggattacaggcgtgagccaccatgcccagccctacttggagtttttgttgctcccaaattctgcacatatttaaaatcgctcaggatgttacctcagatggctaattatacacattgttaatgttgctaaatgaattctgaatcatagttccaaattctctggaagccctctgtgtctgtgaatcaagtttcacacaaatttaatataccttgaacacagcatcttttttagtactcctggtagaactgttatttcatttgcatttaaaccatttctgagtaataccacttacatgctaaatcttagactttatttcaaaataaagtagtaaattatgttctaacaaaagaccaatgacatttataagggagaataaaataagcaacaaatttaaagcgaaactaggttactttatgctgtctgcatttgtatagtggattttggtgctaagatgcaagtctgaaccagtgtaattctgtgctttgctgtgtttacaactttccttaaaaaatcaattcctaaaatgaacgtattttcaaaagtcaaattggtgaacttgcactttaaaaaagctttttaaaggcacatttttatgaatcttcctttccataatctggtaaaaatcatttttcattgtagaggcaaaactctttttttggacatatccaacccatatttgaaaaagcaagtgagctcctctaaacctaattgcaaaatcttaaggaaatctgattgtttctagaagctaaagattactggctgggtgtggtgcctcatgcctataatcccagcactctcggaggccaaggcaggagcatcactggaggccaggagttcaagaccagcctaagcaacacagtgagactcccatctctttatagaaataaataaaaataaagataaacttagtgctgaagaggtaaatagcactacctcttagttttcttcttctataagaagtgctcacctatgatacccttttgaaaaacctactgcatcttttccatttcctatttcaaaaatagaaaaatattaaatattagaatgctaatattcaacataaacttcaaaagtgagattttagcattaactctgttatttggttaaaatcttgaatttaaaacttctacctgcagatattaagtttagcttttagtattttatgtgtgcacagtggtcttaaaagtaacgatgtactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaaaaaaaagtaacgatgaaaatcttggggtgttaaaaaagaatagcttaaaacaaaatgagaagacaggccactgactgagagaaaatacttgcaaaagacacattcgataaagaacacaactgaaatatacaaacaactcttaaaattcaacaataagaaaatgagtaacccaattaaataatgggcaaaaaacctgaaagacatctcaccagagaagatatacaggtggcaaataagcccatgaaaagatgctccacatcatacttcatcaaagaaatgcaaattaaagcaatgacaagatcccactgtacagctattaagatggccaaaatccagaacactgacaacatcaaatgctgacggagatgcagagcagcaggaactctcattcactgctcgtttgaatacaaaatggtacagtcactctggaagacaggttggtagtttctcagaagactcctggcatatgatccagcaattgtgctctttggtcgttacgtaaataagttgaaaacgtctatccacaaaaaacctgcgcacagatgtttgtagcagctttactcataatttccaaaccttgtaagcaaccaagatatccttcagtaggtgagtgcataaactgtggtgcattcagacaatagaatatgcagtgctaaaatgaagtgcgctatcgagccacaaaaacctaaccaaaacaacatggaggaaccttacatgcatatgttctaccaggtgaaagaagccaatctgaaaaagctacaccctgtgtgactccaactatatgaccttcgatggagacaaaactagggagacagtaaaaagatcagcggtcagcagggatttggggggagacagggaacagacagaacacaggaaacttctagggcagtgaaactgttctgtgtgatactacagtggcagatgcatgtcattatacatttgtcaaaacccacagagactgctctaaaaagtaaagtctatgtttgaaataaagaaaaatagcttatgatacttcaaaaatcaaagtctaatatgagacctgttgttagttatctgcagtcattttgcttagcataaactctatcaagttctacagactcagagggaaaaaactactgtgaagtctataatcgtatttttatgcttcagatattttttattgaatttaacctcaagtatgctgcctcatttcattctgaaataatttcagaaagacgttggagaattaaatgtgggaggcagacatgaaacattttttctctgaagaaaaccaccaagttgattccaaacgtacatacttgggggaggcatatgtaatttgtctggttttactcatcactatttgttatcagggagaaccattctcctttttgaaattcttcagaccagattcttagtagtccaggctcaacttcttggcttcatttctggacatgaccactcactgccatttattcaatacctactatgtgctggacttcatgtctgatgatttatatgtattttctgtaggtctcccatcaaccctgctgaaaaacattttgacaatttatacattaaaaacattgcaattcaagaacattaacattctaatattacaaagccaatgaacagaactgccagaatttgatctaaagactgcccacacccaaaacccagttgctttccataatgtgctgtcaggttactttggaaaaaccttaattcatccctgaggaacattttctgtaaagcttctgccatcatcctattagtatttctttactgcctcttacatttctgctaacagcatacgttctcccatcttctgagaatagaagcaatcagccctccctgactctcagttaaagagagagatcccagggtttggcaccatacctgtgtctgacgtcagcttatacccatcctcatgtttgaagtgatcatcctggtatggtctgttttttgtttgaactcttgtagaagatcaactcaggcaaggcgtggtagctcacacctgtaatcacaacattttagaaggccgaggcaggaggattgcttgagctcaagagtttgagaccagcctgggcaacatagcaagacctcatctctactaaaaatcaaaaaaattagccaggcatggtagtgcatgcctgtagtcccagctactcgggaggctgaggtgggagaatcaatgacctaagcccaggaggacgaggctgcagtgagccatgattgtgccactgcactccaggctggatgacagagcaagaccctatctcaaaaaacagaacaaaaaaaaagaggcgtagtggctcatgcctgtaatcccagcactttgggaggctgaggcgggcagatcataaggtcaagagatcgagaccatcctggccaacatggtgaaacctcatctcttctaaaattacaaaaattagctgggcgtggtggcgcatgcctgtagtcccagctactcaggaggctgaggcaggagaatggcttgaacccgggaggtggaggttgcagtgagccgagattgcactactgcaatcagcctgggtgacagagtgagactctgtgtcagaaaaaaaaaaaaaaagaaaaagaaaagatagatcatctctctcttcccggtgctgctgaagggtaagatgtaaacctagagtgctcaagaatgtaaatgtagagagccagcacaggagccagagacagagcggaagcccagggaaggctgttcacacccggtcccgctgccctggaagctagcgtctgctcctttcagtcatgtgcactacaaatatcccttcgtttttcctttggcacaggcaaatgtgggtttcctgtcttttgcattccctaataatacactgccctacttatttcaaactgtatggttaggcagggtgctgtggctcacacctgcaatcctagcactttgggaggctgaggcaggaggatcacttgagcccaggagtttgacagcagcctgggcaacacagtgagaccatgtctctaaaagtaaaaaaattaaaaacaaataaaactatagttcaacattgctggtaggactgtaaaatggtatagctgctctggaagagtttggcagaagcgaaagcttctgttcacataaaatcctgtaaatgggtgatcatggcagcattattcacaatagccaaaaagtagaaacaatctaaatgtttatcagctgatgaatggacaaacaaaatacggtacatccatacagtggaatattaagcagccataaaaacaaatgaagcacgcctacatgctactgcatggataaaccttgaaaacatgatgctaagtgtaagaagccagtcataaaagatcacatattatatgattccatttataagaaatgtccagaaagggcaaatccatagagacagaaagtacattagtggctgtctagggctagggcagaggggaaaaatagcgattgactattaaagggtttcattttggggtatgaaagtgttttaaaatcagacagtggtgatggctgcacaattctgcaaaaatactaaaaaccactgaattgtatgtatattttaaatgagtgaactgtatggtatatgaattattaccacaataaagctgcttctatatttatagtttgacatttaaaatttagtcacacttagagttcaactttactactctactactgaaaatatagagtgtatgaaggatttcctccaattacatgattctaaattgtcatagataaaacactttataataacattctttaatgaagatataaactcatcaagtaaattacaaaggaaacaaaaataacaaggacaaaattacatagtttgatacctcatgagacataattaaattcttctcaaagtttagctgaacaactatacagtaatattttcaaaaacctgtttgttttatacaaaagaatataccctaacacagtagagtctcataatgccttggcgaacaccaatttgatgctttaagattttaatgtattgttaacaaattttcaaactcaggcaagtttagaaatgtcttcatattgaattccttcaactctgcgtccttttaaagggccctacaaattaaaataatttaaaataaggttaaaaacacatattcctaaaagacaaaaaaatgacaccatacttatggatacaaatttgccttttccgcatccctaaaataccattaagattgttaacatttgtatacatctatgaattttaagaataatctatggcattctcattaagaactaccatattttcttctgtgacatctgacatacgttatcaatagacattgtggcagagacctgcaagctgttcagtatctcctctgcttcctggataaatagccagtttcctggctcccttgtggttagctgtggccatgcatggagctccagcccatgaaagcaaacagaagtgacggtccagacgtgctataactgacacacaatctgccaagctccttttgcctgcccagtgcacacagacatggcaactggagatgccacttgagggcagtagaggcactagctggaaggaccctgggttcacaaatcgccacttagaaagagttccctgatcaaaaatacccatttggggtttttagagtgaaacgttaacttctaccatgtttgtgccattgtccatttggggttttcttttttttataggaaatatcattttgtaagcattacgatactcaaacatgtttgtctaggttggctgtgatagttacactggtccagattataaaaagagtccaactttaactttattttcttctttcatatcgaacaaaaagggaaagaggaaaacttaattaatgaaagatattttctatcacaaaagcggatataacctgggaacacagaggctaagaatatgggctgtgaacctacactccccaagttcaaatctcactttcaacaattgatttaacctctctgtccttcagtttcctctctgtgccttattatctcccagtggaaataatggtaatgtctgtatgattgggttgttgggaaatataaatgagttatttcatataaagtgactagacctggaacttaatatgagtgagagctcaataattttcaactctaattattatttaatcttttgtttaaaatttgagagttgggtcgggcgcagtgctcacatctgtaatcccagcactttgggaggccgaggcaggtggatcacctgaggtcaggagtttgagaccagcctgaccaacatagtgaaaccctatctctactaaaaatataaaaattagctgggcatggtggcacacacctgtaatcccagctacttgggaggctggagcagaagaatttcttgaacccggaggcagaggttgcagtgagctgagatcgcgccattgcactccagcctgggcgacagagtgagactctgtcttgaaaataaataataaaataaaataaaattaaattaaataaaattaaaattaaatttgacagttaatcctctcccttgcaaaatataacatgatgatgatgacaataatgatgatgacaatgatgatgactctaaccctagaactgagattttaacatttttttactgcttcccttcacaacaaataattatcatatttaaaggaattaagttcccagataaagtataacctaggttagatttttcattatcatgtttaatggtctatggtcaattacatttttctgataagtaccataaatctggagaataagaagggagccagacatttgggcttatagggcaaatagctaaaaagctgaagctatttaggaacaatttattggatgttaaaaatctgcttgatatatgtataaatttcaaatattatcaacgacatgaaaacttaaggtgccagaaatgataaaaataaccacttgcaaagctcaagtgatgacacaagcatatacagagattttttttttttttttaatgaggacaggctgaagaaaggaagaaaaaaaaattaggagacagattccctttttttttttttttgagacggagtctcgctgtcacccaggccggagtaagtggcgcaatcttggctcactgcaatctctgcctcccaggttcaagcgattctcctgcctcagtctcccgagctgggacttcaggcatttgccaccgcgcccagctaatttttgtatttttagtggagatggggtttctccatgttggccgggctggtctcgaactcctgacctcaggtgattcgtccgcctcagcctcccaaagtgctggaattacaggcatgagccaccatgccaagctggtagattccctcttctaaaagaagtacatgttgctttgcaatcaaacagaaaggcttttcatgtggatttgctgctaagttctacctcagtacagaagatgaaactgggtctacagtgcagaaggtgagaaattagtttttgatgaatggacacaacctgcgaaccaaaggtatcgagatggaactcaacacagcctcaacagtaatcagttgttttgtgtttccctgagatgaaaacatgaaacaggatctgcatttgatagcactatgaaattaataaggtaagtttcatgcatggtccatgcaaaaaaaaaaaaaaaagaaattaataagggaaggataagcaagttgtcaaggaaatactggattttctactgccttatgctgatagagtcagagaaaatcttatagagttttttgttaaaactcaatctgctaatttagtcagactgacatgttcctcaatgccaagtaggagtcctttttccctttcttccccttagtttacgttagtaacagttagcaagtaacagcttctaggttagcattgtcaggatcagaaagaaaaaaaaaaaggagaaaagcttgatttactgaaatgagaattctctcaaataaggacctaaatggtttttccagaaaaccttcctagacacatattctctaacaggtccatgggcttagggggcctataaactccccaagagaacaaataaaatttggcaattatgtgcaatgttttgaagagtctaaactttcattaaactctctaagtgagctattactcccaagctcccccagaaatactaaaactgactgtactggagataaaaaattcttttgtttagcatcaaagatatgcagtgcagtagttcagagttctaaaaggaaactttctttctgaagatatctcagacctcactcacagacctgtgagtgaaatatcagttctaagtcaataaccaactttatttataagtcagagttctttaaattactgtattgatctctgctaccttaaatcctttatgaaaaaaggggagacattttaaaaagtggttgacctctgtggttccctccctcttgacaatgactttacttcccccactaactttactatgccaaattgagttttatattcgatatgaggggaaaaaaggatataaaactgtacctattacacacactttcataaaacaccaagattggaaaggaacagaccaaaatattaatggggtttattgttgggctgggggactatgattaatttttataattatttatattaaattatgttttttggggttttatgcatgagtacacatttcttttataatcagaaaataaaatactttagcaatggcagagtcactggagaaaataagcttacagatttccaaataggatagaaggctaacaaaaaactcaaattctaaaataaagaacaatccaattaaaaaaaactatggcacatttttaaagcattttgaaatttctgtctttgtgtaaacaaacttacagtttcaatgacgatagtagctgaaaaagtcttctcattgatggattctagggtaccttcatttcctctgtagcctccatttaaaactagaattctttttcctatgatggaaaagaatataaaaattaatgtgaagaaatatctccacttttcttctaacttgttacagcaaaatgtactacactgaataaacataataaaaaacaaaaccctttttcttagaagttctcaatcatttaagaagtgtgtagtattttagtgcggtgtatggatactttcactactcgaacattataagacttctcatttttcccccaattatttgttaaaggaatatgtatgttttacttttagactgcaaagaatataaggtacttggagaaaatgttcagagtccagaagtaatcagagacaatttagcttactttgtctctttgcaaaattcataagatggtttggcagttttacaaaaatttaaacttatacctaacatgtgactgagccattctatgtatttacccaagaaaaaagaaaccagatatccacacaaagctttgtacgtatatgttcacagcagttttatttttaacagccaaaagctgtaaataagccaaatgtctatcaacagataactggataaacaaactggtacagtagtccccccttatcccaggttttggttactctcagtcagcgtggtccaaaaataggtgtgtaaagtacaataaaatattttgagagaaagagaccacattcacataacttttatcatactatattattataattgctctattttattattagttattattctcaatcttttactgtgcctaattcataagttaaactttattatagatatgtatgtaggaaaaaacatagtatatatagtgtttggtactatccatggtttcaggcattcactggtggtcttggaaggtataggttaagggggaatactgcatatccatacaatgacatacagcaagaaaaaagaatgaactacagatacgttccaccacataggtgaatccaaaataattacactgagtgaaagtagccagaccagaaaacaggacacatttatatttatagaaacttaatttatataaaattctagaaaaatatgaactgaactatgacagaaagcatgtcagcagatgtcgaggaagacagaggatgcaggagcagaaggtaggagggagggattagagagggaaatgagaggatctattcatcagctagattgtagtgatggttttatggaagtaggcacatgttgaaacttaccaaattgtatactttacatatgtgtgatttattgtacatcaattttaccacaataaagctaacataaatttttctaatctgtaaaaagaatttttactttagggggaaaaagaataaagaatatgataataagaagttccagagactgatgttatcactacattggcaatgacacccccaggaagattttgagtcagaggtaaacaacctggtcaaagtagtgtttgtactcagatacggataagtttccaaaaggcaaagacacctaaggggaaaaaaagcaaaataacacagactttcacttgactatcgcagagagctaaacaaatacatcacagattgaacattcctaatctgaaaatttgaaaagctccaaaatgtaaaatcttttgagtgctgacatcatgccacaagtgggaaattccacacctgacctcctgtgacaggccactgtcaagatgcaatcaaaattatttaaaatattgtataaaattaccttcaggctatgtgtgtaaggtgtatataaaacataaatgaggatgagtatggtggctcaggcctgtaattccagccctttgggaggctgaagtgggtggatcacttgaggtcaagagtctgagaccagcctggccaacacagtgaagccccgtctttactaaaaatacaaaaattagccagatgtggtgatgcatgcctgtaatcccagctacttgggaggctaaggcaggagaattgcttgacctgggagatggaggttgcagtaagtcaagatcgtgccgccacactccagcctgggtgacagagtgaaactgtgtctcaaaaataaataaataaataaaaataaaataaaacataaatcaattttgtgttaagacatgggttccaaccctaagatatccaattatgtatatgcaaattccaaaatccaaaattggaaactcttctggtccaggcatttcagatgagagattctcaacctataaccataagcctaatataacaaatgctatccatatatgtctacgttttgcttcaggaaaaaaaaaaaaaagtattccaggaaaggaaaatccattgatgccacaaaacagcttcatcagagagccagtaaactacgatgcccttgaatccaaacagagatgagttacgctggcagttaatgccgccaagacagaaaaataacaaccaacaagtactgtcaaaatacagtggtttgaaaatggaaccgctcattttgatggcatatgtattaaatggtctgcaaacagatttacctggtgctggaattactgtctctaaatgagtctggtcaagtttcagcttgtctccagaatcaatcatcttcacaacagctgtatatttgtcaattacttcctgtcatgtaaaatgaacacttttataatagaagaaatatgtgcacactcatttaaaaggtcaaaagcaaatgaaatgaagacaaataaaatatcaatcaaaagaaagagtaactccttctataaatgacactattttctagattccatacatgatttcccagtctatggttctcaataaagaactcaattcaaagcttagtaaaggttttcatctggaaacaataacagattggtggtcctggaataagactttaagaaatctaacaagaggggtagttttgcctagcttaatgtacagtggaagaagggcaataggcatgcacaaggctgggtgctagaataaaactaaatttaggaaaggcaaaaagggagaaaaggcctagaatattgatacaaactttaaaatctcagagtaggccgggtgcagtggctcacatctgtaatcccagtactttgggaggctgaggcaggtagatcacctgaggtcaggagtttgagaccagcccagccaacttggtgaaaccccgtttctactaaaaatataaaagttagccaggtgcggtggtggccacctgtaatcccagctactcgggaggctgaggcaggacaatcacttgaacctgggaggcgatggttgcaatgagctgagatcgcaccactgcactccagcctgggcaacagagccagactctgtctcagaaataaaaataaaaataaataaaatcccagagtagccaaaagacagtttctcaagcaaaacacaagaagtcctcatgagacctctgacagtataattgttaggctggcataaaagtaattgcagtttttgccactacttttaatatatggcctatcattaaaaaataaagtacattttactgacaagcaaggcatgcatgctgaggttttgaagaggtgctgatgggccttcatacatactatctgtcctagtaagaaaacagatcaacgctgagtagaaactatggatgaaaaagaaatatttctccaacaatcatgaattcagcttccatttcatggaataatcaagaattttaaacatagtacttctgctactaggacttgattttcaagaaataccaaaatagcttcactcagtgacccaagcttttttcacaaattccattcataattgcacgtccttaccttaacaatagcctttttcttatgatatttctctcccagtttcttggttataattttcacaataatttcctagaaaataataacaaaaaaaatgaaaggaaagacagaagttatcgtttgtcatttacttcttccttttaaactatgttcacccaaaaccacaggaaaatgtaactgccctgccaaataagaaatgctggagttctctgccttcccaacaatgacaaacatttccttagcaatcttttattccttcttcccctttctgttcaacgtggttagcaagaggaaaaaaatatatacatatatataaaaaatgtctgatttctacattgcagatttctggaaatctaggactgttatcggtaaaattcaactctagtacttcacgtctttcgtagatggtttctttccattgcaggaagtgaaaagcgctgagttgttcactgctgataaaaactcagattgcaagagactcactggaaattgcaaggcactgagcctgcaagcttatgcaggacagttctcactatgcccctttctcattaagttgctttgaattttcatacagttgggattcctccagattagatatagctaaaggtattgttcttctgaccatctaattctcaaatgggagggaaatctgggcttacttcttatgaatgaattcagagtttgcttctttaccattttttcctgatttggattagttgtctaaaagctaataatgaaaattaaattgcctaacaatgcaatattactgcagtgattctatatttgctacttcaagtgaatatatcaaagagatggtcaagtatttcataaagccatgcttaaaatcgtactaacaaaactttaggaaggactttggggagagggtatttaatagtagaaagataggtttacggaaaaatgtgaacggtcttattctgaagtctctcttttaagactttctaaatgaagccaattaatgccaaaacaacttctccaatttagtcatactattttctgggctaatttctcaaacgctctcatgggttcacactctagtaattggaagataattcattacatcactgtacttattggcccttatccacagtagatctgttaaaaatatttcctttctgagtttaaaaactaggcacagtgggccgggcgcggtggctcacgcctgtaatcccagcactttgggaggctgaggcaggtggatcacctgaggtctggagttcgagaccagcctgaccaacatggagaaaccccgtctctactaaaaatacaaaattaaccggatgtggtggcccatgcctgtaatctcagctactagggaggctgaggcaggaaaatcgcttgaactcaggaggcagagattacggtgagctgagatcgtgccattgcactccagcctgggcaatgagagcaaaactccatctcaaaaaaaaaaaaaaaaaaaaattcggcacagtggctcgggccagtaatcctaacaccctgggaagtcgaggcaggaggatcacttgaggctactatgttgaccagcctgggcaaaagagtaaaaccttgtctctacaaaaaatacaaaaattggcagggcattagtggtgcatgcttgtagtcctagctactctggaagctgaggtgggaggatcgcttgaggccaggagtttcagaccagcctggtcaatagagcaagaccctgtctctatttaaaaataaaaaaaagaataagacactctgaaagttttatgaaaatgtcatgtctcagtaagtctaaaatagagcatcaataaataatcattttaaaatattgttaaatgtttaaaaactatttttaaattattttaaaacaataagcaataataaataagcaataaaatataaaactcccttgagtttgtgaaattaaagcctgcttttctccacaatgtacctattaataaatggacattctagttccaataagttgtaaactgaaaaccaacacttgggcatttacagttctactttttgaactcatttctgaaaacataacctcttgtcttatagcaaaaattgaaaattcctggctcaaatttaagatgcccataaacaagtttagcactaaacttaaagaacattattagtctataagcatgaagtaactctccaatagaggtgcaaccaataattaatgatctaataggaagaaaagtcattataagttataactaactctatctatatagattatacgtgtttgaaaagtttagttacttataccaaatgctagttaaatcattcacttaaacatacatttagaacttaagaaactccaactgaatacttacaggctgtagccagtagtctgttcgggcagttcttttcttttcctcttcaatctgtagaacacataatgtcttaaattatctccctaaaatcctcattggatttcaaaataccattctatttagcaaaataacaccataaaactgtgaagtcctctacttcacagaagaccaatgacataatttgcgagctctgataaatacaaataaacattacttgtcattagtttttgatttaaaaaaaacttcagtttttaaaagtatataataaagcaagtcaactgacctaggaagcaaacagacacaactcctattcagctgaaagaccagccagtacctgccctcacccactttctcccatgtgactgtcaggagctggaaaagaggccacgttttcatgcagtaaaatcataacacatggatcaatgtagcacagtgtggttaagtatacagcctggtagcaaacagggggctccctgtttgaaaatgacagtaaagctcatgaatgaaagggaagaaaaataccaccaagagataaatgagagtgaccaaagaaaagagagctgtggggctgtatggcgaaaatatcgaatctttttctttctcaactgcttacagttaaccctaagtaccaattttcaatgggatcaaacaatgtaataatcccttggttgattcgaaacctaattttaggctgggcgcggtggcttatgcctgtaatcccagcactttgggaggctgaggtgggcggatcacgaggtcaggagtttgagactagcctggcgaacacagtgaaaccgtgtctctactaaaagtacaaaaattagccaggcgtggtggtgcatgcctgtagtcccagctacttgggaggctgagacgtgagaattgcttgaaccctgtgaggcggaggttgcagtgagccgaggtcacattgctgcactccagcctgggccacagagtgacactccatctcaaaaaaaaaaaaaaaacctcattttaaatccttcaccttttcaacaaacagtgttctaaaattagtatgcattatattcaaaaaaggtcgatttggctttccatttttctttgaataaaattaaattttaaaaatccctgtcacagcatgtaagacctctatggtgttggccctcctggctctctgacctcatacgccaccaggtgcttgctgcactccagtcccgtgggcctttccttcagatgcttgatcgttcctgtctaggtaccgttcacaggatctctccccaggcgctaccctcatacctccttggcactcagcattttgtgatcattcactgattcactgctgaacagctctgacgttagaatgaaagctccgtgactaacaaggactgtttttctttctactatacagacccgggggcttgcacaatgtgcagcatgtaacagtgactcagtttcatagtaagtttcatctaaacattatacttgaagctttttagatcatcctgcatggtgtgaggactaggaacagagaagactaacagccagccgggtgcggtggctcacaccttgtaatcccaggactttgggaggccgaagcgggtggatcacctgaggccaggagttcaagatcagcctggccagcatagtgaaatcccgcctctactaaaaatataaaaaattagccaggcatggtggcgggtgcctgtaatcccagctactcaggaggctgaggcaggagaatcacttgaacctgggaggtagatggtgcagggagctgggattgcaccactgcactccagcctgagtgacagaacacagagcaggactccgtctcaaaaaaaaaaaaaaaaaaagactggacggcattttctatcccttcacaatgaagacgaaaataaatgaggagacagaggaaataatattaaagaaaaaaaagttagcttcttgtattcatttactctttctcctctatcctgcctcttctctcccacctattttcttaattcattgataaggtaggctatgtgttagaatggagaaggggatatttaggagtaaattaagaacctcctgcagcattactctagagtcttgggtagatttagagcccaagtatggccctaaatatggataatcatgtacttccaatgatttttcacatagacttagccatcaggctaaatcaaattaaaaccatgtcacactaggccaggtgcagtggctcacacctgtaattccagcaatttgggaggtcaaggtaggcagatcatttgagatcaggagtttgagaccagcctagccaacatggtgaaaccctgtctctactaaaaatacaaaaactagctgggtatggtggcacacatttgcaatcccagctactcggggaggctgaggcaggagaatctcttgaacctggggagcggagactgcagtgagccgagattgtgccactgcactctgtctggcctgggcaacagagagagactgtctcaacaacaaaaacagcaaccaaaaaaaaaacatgtcacaggtttctcgtgctcgctaggaggtgctaagcggaagtcaaagtcaacaggagagtagcagttgaaggagggaggccaaccatgaaggactccaatttctaactgaattctactgaccgtaacaagcgcagggagtttcaaagacagcacctgaggcattaaaagaaacctatttaggtggggcatggtggctcatgcctgtaatcccagcatttgggagtccaaggtgggtggatgacttgaggtcaggagtttgagatcagcctggcaaacatggtgaaaccccatctctactaaaaatacaaaaattagccaggtatggtggcaagcgcctgcaatcccagctacttgggaggctgagccaggagaatcatttgaacctgggaagcggaggttgcagtgagctgagattgtgccactgcactccagcctgggcaacagagtgagactccatctcaaaaaaataaaaaacaaataaataaataaacctatttaggggggctccaactccagttcggggaactgtatgtagctaggtcactattccctagtccgtacatgataattttcctaattttctattaatctaataaatggtgaaatgatttaattttccttgggttctaaggtgtccacacgcaatccataaactgtacctccatgatttcatccagtgcagatttctttttcttcttttctttagactgagttgagctctgggaagattcttttcgtttcactgatgctgaacttcctatcgtcttcagtgcactcggtcccagagtactgatgaacaggagaaccatgcttgttaccaagaaccatacacagacgaatgctttacgatgtgcaaaattcacaatatagaataaatgtgtgacatagtaatttacaggagattagtgaaaaccatggagtccctgtccacatctcttacagaaccatcagcactgtgtgagcatttaacccgtgctatctttaactctctgtacctatcagcactgtgtgagcatttaacccatgctgtctttaactctctgtaccttctcctcactccttcggtcactgctactatactttgtatagtagaatgatggtaggcagcttaggttttggtgttgagcagatcagggtttgaggctacttctattaggacttggagtagttcactttcctaagcctcaaatcttcatctataaacgaagataataacatgacccaactcttaacccaaatgcaagaattaaatgacatgttttcaaatgaccggtttaagtctagcacgttactctcagttctggttttgtaaagcaaagttctcaacgtgttacttaaaagtttttaactgctcccaactgcccagagttaacagtgtaaatccttttttttgagatggagtctcactctgtcgcccaggctggagtgcagtggcgcgatcttggctcattgcaacctccgcctcccaggttcaagcgattctcgtgcctcagcctcccaagtagctgggattacaggcagccaccaccacgctgggctaatttttgtatttttagtagagatggggtttcgcaatgttggccaggctggtcttgaactcttgacctcaggtgatccacctgccttggcctcccaaagtgctgggattacaggcgtaagccaccgtgcccggctgacagtgtaaattctaaattctttactgccaatatacaactgtcaccattggccccagaataccatcctagtcaccatccctgacttactatgtacaccagtcactaagaacaatttgctattgactgagccatgccctatgctttcagcctctgaaaatttgcacatgccttgttttatacctaaaataatctctccttttatctccatttgttaaaattctttaaggtccattcatgagggttcttggatcttgcagtgttttgaactgccacagtaccttgtggcatgcatcacactgcaccttgtatgataatcatttgtatgtacgactcctctcttgtagtagggaggaagcatctattttttcctgcaaagtagcagtaactatcttgtaactcacattaaatagatgctccattaatactggctgatcaaatgacttttacccatctaattatttaatgtgtcatatttacaaaagatgaagcaaaggataaatatttacacaaagctatcatggagctaaccaagaaaaaaatatatgattagtagagaatacaacagatttattattttcctttatttggactttaaaaagtgcatttaaaggtagccttagattgatgaactgctgggttactttaagcttgaagtcaactaaaacccctacttcttttctctatggagaattgtaggtaaggactctgtcactctgtttttatgggggttgtttttctttacctaactgtcaggctttccatttacctttgtaaaattttactcactgggttttgacctgtaattcaacccactgaacatatatttaaactctggttctattactgaatgcattgcccagggtgtgacagctataaataatggacatgggttttgaacaggccaaatccacgtaagataagctcctcaacttgctacttaaatgttctttagatttaggtgtactttgaactagggatccagggataattcagatcataatcaactacaatatgtctacaaaataggcactaataaccctagcaaaagaggagttaggattaagcagttatttttggcttgagggatcaccacttcctcgtctcatgttcacaaaccacctacttcctatcataatctgttggaaatgcttattaatctattgttttctaaagacttttctccacttaaaaaaatatatttgcttatttttctgccttctgactcctctaccaatctccatgatacctcagaggttctcaacagtgagtccccaaatattaatacatctataaattatttcagtattttggtattaatctcagcttagacacttgagtttatttaaggctattatttactcttcttaaaactcaactgggccgggcgcggtggctcatgcctgaaatcccggcactttgggaggctgagacaggtggatcatttgaggtcaggagtttgagaccagcctgaccaacatggtgaaatccagtttctcctaaaaatacaaaaaaattagccgagcatggtggtgcatgcctgtactcccagctacttgggaggccgaggcaggagaatcgcttgaacttggaaggcagaggttgtggtgagccgaggtcatgccactgcgctccagcctgggcaacaagagcgaaattccgtctcaaaaaaaaaaaaaaaagaaagaaagaaaaagaaaatttactcagcatcattaaatgcttagaatgtgacaataatggggaaaaagatgatcagaagagcccagcaagatctcagggtgatgtaaagggcattccaggaaggggagcagcagatgtaaaggcaagaaagggcgagaccctaggctcatttaggaaagcacaaatcaatgagcacagctgagagcaaacggcaggagacatacaggatcacaaaagtcacttaatagtatgtaaaaaaattcgaggtcatcttagagatgctgaaaccaagagatgttaataaatgagtgacacggtaagagctgaagtttagaaaggtccttttgctggcaatatcaagattctgttagaagggtgagagactgagacaggggtaaggcagagttaaaataaaatcaaggcaagatatgaatatgagcagaatgaaaatggaaagtaaggttccttgaacagccctcatttttgctttcagtaactagagtgaattctagcctttctcaaaggagataaagaagcccaaaggagaaatggagatgaaaatcaagtaaactgtttcaagcaataagggggctcatttttgtgcctcaacatagcctaaaatgtccactttgatatccacatcatttagtttttctaggttttagatatataagagatataaatgcacaggagaatgaatcccaaactatattatgtaccataatttcagagaaaaaacattttagatgtctttcaattgtattacccatgacactacattcttatacaaatattgttccttattcatggactcgggtcacaacatattaacatagataacttatcaaataaattatcaaaattggtcaaataaaactaatatttttgctaatatcaaggtttggcataggggtacagcaggctgtatagacccccaaaaatgtcaggtccttatccctgaaacctatcaatgttacattatctaagaaaagagtctttgcaaatgagagtaagttaaagatcttgagatgaggagcttggcctggattatcaaggtggaccctaactacaatcatcccttttcttgtaagagcaaggtggagggagatttgacacctggaggaaaaggtgatgtgaggatggggcaaagagacatttgaagatgctcgtcttaaatactggagagatgcaaccatgagccaagtaacgcctgcggccaacagagctggaaaaggcaagggacagattcttccccggagctcagattcttccccagagcacagccagcaggctccttgatttcaagccagtgatactgattcagaatctggcctctagaatatgacctcaacatatttctgttgttttaagccacccagtttgtggtaatctgttacagcgaccatagaaaactaatacaagggaggtcaattggggaacactggaaccaattttaacatccatctacatctaggaataacacatacttcaaaagaacagacagaaatgcataaagttctaaaagtataaggcatgtgtgttatatttgagccgatcttccaggtcatatcatgccaatgttagacaattcttctggaatgtacccagatgtagaacccaaataaccaacttcttgatgatatctaatgtaggtgttaattttgaaacattattttgatcaaagttaagacatctggcaaatcattttaaagttgatctatattgctgattcagcctacctatctccttccatactcctagccacttattcaatagtgtaaataaacaatgacctacaaacaaacccgaaaaacttagatcttaaaaaaacaacatgtaaagtactaagtaaaatagaaaatatcatctggcttaaaagcaaattccagtagatactggtacttgactctcttgtcttactcatcttttttaacctccataacaaaactgaatgtactgcatgtcagaaatagtgaataaagatttggtgaaagaatacataaaaattgcaagagaagataatgtagaaagtaggtagaactacctgaccacatgctatgccaggttttggcaaacgacagcctaagggccaaatgccagctgccaccggcttttgtaaataaatgtactggaacccagccatgctcagttccttcctgcactgtccatggctgccttctcactacaacagcagagttcagttattgtgacaaagacatctggccgaaaagcctaaaatatttactatgtggctctttacagaaaaagtttgctgacccctgccctgtgctagactacctagaagggcgggcaatgactactgagtgtttcctggtgtatttacactgtactggggacgaaggagagaggttgataatctctattctcagaaaactcacaatgcagcaagtaaaagaaaaatgcagatccagctaacatttaaactgtgacaagtgggctaagacaggaaaagaaacagttttatatagcgaataaggaaccgttaaatggagaaggattcatggagaagcaaaagtttattgatgtgaaacatataatcaaaatgaggctttcctcaaaaaacacaatcatctcataacaggcaaataggaaaagaacagttgctagctgggcacagtagggcgtgcctgtaatcccagctattgatacctgggaggctgaggcaggaagatcaccttgagcccaggagttcgaggccagcctgggcaacatagcaagaccccatctcttaaaaaaaaaaaaagaacaattgctaaaaaaacaacgcaaccaataaaaaccaaaaacaggtgaaaactacaactagaaaaaaatgattcacaatactttaaaatacagtaaccaatatttcacaaaaatcctaatgttttaagatatccgtgaatgatgcagctcaccttgacttggaagatgttgctccggatgagctacatgctcctttactcaaattaaacgtgactagaagaaaaaaatgttattccatacatacatttcaagaaaatcataataaaacttctcagataagatactacaaagtgttcacagaggaactccaggacattttcaataaacgagagctaaaatgttcctatacggagaccacacattcctgtaaaacgtcccacactgaaagccatagaacaggaggaacttgcacaccgtgtcaccgtggcagaccacaccggcgcttccctgctctatccccatttcccctggggaacagtactccaattctgtttaggtctccacgcctcttgcctgtggctcaggggacataacaccattttcatctctggggtgaattctgattgtctaatccaatcaacataatcccagtgactgctttttgagtggacatgtgacacagttctggccaatgacatttgaaaggaaatctattgaagggaggagtgtcttcttggaaaagtatccttgctcttaacaagattctagaagagcatccagagatgctctctgccatcctcacgacaatgcagaatctgcatgtgacggctggagtgttggcagctaccctgtgtctagatggcatgcagaaccaccttacctctgggattcttattatggcaagatatttccttattgtttaagttaattgtagtcagttttgttacttgtggcttcagctatcctatccaatcaattcattagtattaccttttcattaaattaataagaacaatgtaactcagacacattcgatgtcttattctcagatatgttgacaagttgcatttttaacaaagccaatataaaagcatctatgtttaaaaaaagaaaaaataaaaaataaaactacctttctcttcatcattttctctgcttaattccgtaaaagtagggacctcctaaaaaaaagaaagttttaaggttttggtgtacattgcacttactatcaccattcaataggcctaaattatgacttgctacctgtgttcccaggcagctctaatacgcaagtgattaagatcctaattaagaaattacatgctttcggccaggcgcggtggctcacacctgtaatcccagcactttgggaggccgaggcgggcagatcatgaggtcagtagttcgagaccagtctggccaacacagtgaaaccctgtctctgctaaaaatacacaaaaaattagccgagcatggtggtatgcacctgtaatcccagctactcaggaggctgaggcaggagaatcacgtgaacccgggaggcagaggttgcagtgagccaagatcatgccactgcactccagcctgggtgacagaacgagactccatctcaaaaaaaaaaaaaagaaattacatattttggcccagtatggtggctcatgcctgtaatcctagcactttgcgaggccaaggcaggtggatcacctgaggtcaggcattcgagatgagcctggccaacgtggtgaaaccctgtctctactaaaaatacaaaaatttagccgggtgtgatggcgggcgcctgtaatgccagctactcaggaggctgagccaggagaatcgtctgaatccagggggtgagtgctgcagtgagcggagatcgtgccacttcactccaggctgggtgaaagagcgagacgagcctggccaacttggtgaaaccccgtctctactaaaaatacaaaaattagcccggcatggtggcgggcgcctgtaatcccagctacttgggaggctgagacaggagaattgcttgaacctgggaggcggaggttgcagtgagccgagatcatgccactgccctccccagcctgggtgacagagcaagactctgtctcaaaaaaaaaaaaaaagaaaagaaattacatgctttggctgggcatggtggctcatgcctataatcccagcactttgggaggtcgagctcaggcaggaggaatgcttgaggccaggagttcgagaccagcttggacaacattgcaagagccccccatctctattaaaaaaaaaaaaaattagccaggcattgtggtgcacacctatagtcccagctactcatatgaggcaagaggttcacttgagcaccagaggtcaagggtgcagtgagctgtaatcatgccactgcattctagcctggtgacagagagagacagtctctcaaaaaaaaaaaaaaaaaaaaaaaatagaacttacatgctttgcaaatattatccaattgagaattattctaaataccaaaaagcagcttttctatgccaaactgcagaagtttacctatatttttatttctattacaacttaaacaggaagtaacaaaaatataaggcaataaactttaggaaaagcaaaagctttttttttttttaagtctgttcaagaacagactaaactaatgaataatcaatcgtggtatactggaacaatggttatgtctgggagatggggtattaattggcaacgagcatgaggaaaccctctgggatactagaaaagttctatatctttatctgggtggtggttccacaggttttctgtcactctttctacacacgtatatttgtaaaagttcagtgaactgtacacctaagattaatgcacctcatacactttaatcaatgtatgttaaagctcaataaccagttcaaaaaacactcagtttcacatacacaccaggctatatttgcctgctcacacacaagtgttagaatgtaagccacaggaggcagggcgtggtggctcacgcctgtaatctcagcattttgggaggcccagaagggcggatcacctgaggtcaggagtttgagatcaacctggccaacatggtgaaaccccgtctctactaaaaatgcaaaaaattagctgggcatggtggcttgtgcctgtagtcccagctacttgggaggctgagacacgagaatcgcttgaacccaggaggcgggggttgcagtcagctgaaatcgcgccactgcactccagcctgggcgacagagtgagactccgtcccccccccaaaaaaaaaaaaaatgtaagccacaggagacagttttctgtatcttttgttcactgagtattccctgtgcctacaagaatcctggcacagcggaggcgcttataaatatatgttgaaataaatgccccaacctagttattctaacacctcagctccttccctccccattcatctggcttgcacccactgattcttcaagactcctgggcactggggttgtatccaccctcaaatactctgtcctccccaggccagagtaaacattgcttctctatgtttccacatgctgcatttacctccagtactgaattaattataatcagttgaaattatctgtgtatatgtcttcccattaggtagcgtctctatttagatataaggaaattgaggtttggaaatattatgcaattatacaagattatgaagttagtatgtcaggaatcaaaccaaggtttgtcaatgccaaaaatgtgcttttgacaccaggctggttctcctcttagttcaggaacagtgcccacagaacttgattcaacgctgaaaagacacaagctggctgggcacggtggctcacgcctgtaatcctgtaactttgggaggccgaggcggccggatcacgaggtcaggagttggagaccggcctgaccaacatggtgaaaccctgtctctactaacaatacaaaaattatctgggcgtggtggcgggcgcctgtagttccaggtactcaggaggctgaggcaggagaactgcttgaacctgggtggcagaggttgcagtgagctgagattgcgctactgcactccagcctgggcggcagagcaagactccatctccaaaacaacaacaacaacaaaaacaaaaaagaaaaaccaagccattgtgcttctttagacctctggacgttgcttctcaggatgatgttgcttacccacctgttccttcccttccaggcctcttctcacttgctcttcaataaatttggcagttttttcttcatcatcaaggtcctgctttttctttttctccagttccagttgccggcggatagtttctgggtccctgtctatgtactgaatataccagccttttggtgtctcgtccactttgcacaagccttaaaaaaacagccactgccataaattagcatacaatcaaagcaaaacataaatatgaatgtgtttcacctctgcatatttattcattcaaacacacacaaatcaggccgagcgcagtggcttacacctgtaatctcagcactttaggaggccaacacaggtggatcacttgaggtcaggagctcaagaccagcctggccaacatggtgaatcccatctctactaaaaatacaaaaattagctgggcgtggtggtgcacacctgtaatcccagctactcaggaggctgaggcaggagaatcacttgaacccaggaggcagaggttgcagtgagccaagatcctaccactgcacttcagcctggcaacagagcgagactcagtctcaaaaacaaaacaaaacaaaacaccaaatacactaaaacacattcaaatacacaaattcatgcagcaaatgggattttccatatttatatttaatgaaatttagatactgtatgtgaattcaaccaaccgtgggtgagaaatattcaaaaaaagaaaaacggatggttgcatctgtactgaacatgcacagacattttttccttcccatttttccctaacaatagagtataaaaactatttacattgtattaaatattataagaaatctcgagatgatttaaagtatgtgggaggatgtatataggttacatgcaagtgctacatcattttattttatataagggacttgagtatctgtgaattttggttatcagcaaggggtcctggacccaatcccccacggatactgagagacaactgtattaccttgcatagtatttattcagttctatctaagtatttaatgtccaacagttatatgatgttctattaacttaaggcagaaattatgctcccaaaatggaatcaactaacacgatgaaaaagcaaaacactgacccaattttttttctcttttcttatcccaaacatctcatcctatgaagattagaagtgggaaagaaaaagcaactttaaaatctcattcttaccttctctgcccagccacttagtaaaatcagtcagagtttcccactgagtggcattcatgtggatgtgctctcggtggctgatgtattcgttgtagacaatgttgttgtggacccttttagtgcctgagaacaaaatatgacactgatgatcatcagaagattatgccatttataaagctgttatttgcacaatatttaaaatgtttaccaaagcgtctcctgagaagttctagaaagtcatttcggaattccctaataaagaaagaaaggaaagcattaaggtaatttctacaaacatatagcatcatctttttgaaatttaagcagtagtacagttttttgtttttgttttttttgagacagagtctcgttctcgtcacccaagctggagtgcaatagtgtgatctcagctcattgcaacctccacttcccaggttcaagtgattctcttgcctcagcctcccaagtagccaggattacaggggtccaccaccacgcctggctaattttgtttcgtatttttcgtagggatggggtttcaccatgttgggcaggctggtctcaaactcgtgacctcaggtgatctccacctgcctcagcctcccaaggtgctgggactacaggcgtgagccactgcatctagccagtagtatagttttaatgtccaaatgatatgtgaaacatctacatgaatatggctatgaacctttaaaaactgatcaaggaaagaactccaaaatattatagcttttaaggattaagttaaaagtcagttgggagttgaaattttttgtcttggtaaagcagtcatagaaacagttaccacatacctttggaatgggtccttcatgaagtctgttagtgccactgatggtggcataatgaccccagtctatctatgacaacaaaactgccctgattccacatgaaattggcacttaatatgtccctctgagctgggtacaccgtattaagtgctagataaacgtgggtgaataagacataaatcttaaccttcaaggaggttacaatctagcataaccaatcataacaaaagttaaactgaagaagaagtgtaacaaaataccattgaaagagtcacaggagatgcccagaggtgatttcattgtggtcagtgaaggataagtagaaccctagaggtgaactgcaagagaaagctatttccagctggcacagaaacatgaaagcctcacagatctgagaaatggcctaatttgactaaaatttatggctgataaaaatgagagtgagagtgagggtagagtagaataagggagacgaggtggctgggaaaccaaaataaggtttggctaatttttgaagtaccccgaatgtcatgcgaaagaggctgagttttgtgcagtcaatagaaaagcattaaataattttgtttggcctgggtatgatggctcatacctgtaatcccaggactttgggagatcgagagaggaggatcacttgagcccaggagttcaagaccagcctgggcaacaaagtgagaccctgtctctacacacacacacacacacacacacagaatcaaaaaattagccaggtgtggtggtgtgcatctatgttcccagctacatgggaggctgaagcaggaggatcgcctgagcccaggaggtcaaggttgtagtaagccatgactatgccacaaaacaagaccctgtcaaaaaaaaaaaaaaaaaaaaaaaatgcctggcatgttggctcacacctgtaatcccagcactttgggagggtgaggtgggtggatcacctgaggtcaggagttcaacaccagcatggccaacatgcctaaaccctttctctattaaaaatataaaaaattagcggagcgtggtggcgcatgcctgtaatcccagctacttgggaggccaaggcaggagaattgcttgaacccaggaggcagaggttgcagcgagccaagatggtgccactgcactccagcctgggcaacaagagcgaaactcccgtctcaataataataacaataataaaaatttataaaccaatttttttaaaaaacttgtttttatttccatgtgttgatacatctaacccacataaacagaagttcttggggtcttcaatattttttaaaagtataaaggggtcctaggaccaaaatgtctagaagtttggaaagaaagagatggtaagaagcaaagaaatgtttattaatggtaatgataagaacagctaatctgaattgaatataggcactcttctaagcactcataaagtgttaattcattgaccttcatataaactctatgaaggatcagcaatacttagaagaggttgctatttttagtgccattttttttttttttttagacagagtcttgctctgtcgcccaggctagagtgcaatggtgcaatctcggctcactgcaacctctgcctccccggttcaagcaattctcctgcctcagcctcctgagtcgctgggattacaggtgcccaccaccatgtccggctaatttttgtatttttagtagagacggggttttgtcatcttggccacgctggtcttgaactcctgaccttgtgatccacccgcctcagcctcccaaagtgctgggattacaggtgtgagccacctcgcctggcttcttagtgccattttagagatgaggagaataaaccacagaaaaacttaagtaggtcatccaaaggcatacagtttttaaatggagaaggatttgaatttgggaagtctgaatgcagaacctatgttctttgtcacaattgtattagaatgaaagacagttttgtatatctgaagtggaagaaaggaaaaactaagttgtgagaaataattttgtaacagttttatactatgattaattttcaaaagaagataaaaactgagcatagagagaatacagttaacatataagaaataatagaacttccaatatttaaaatattaaccatctattaaatgttcaactgaataaagcctataagataaagagttctttgagttacttactctgaaaaataatccataaactgctgaggattttctgaagccagcaatagttgtctctgatgagattcggacatacaatgacacttaaagccattctacaaaaaatgtaaaagcaataaattctgatttaggtcatcaaaatgggctctaaatagaagtatttagttaaaacccaaaaaatctgctctttgatgataaattaaaatataatcaaatcattagctgtaactactctatcaggttttcaaaaaaaatttttatagagttgagctttcaactctgctaatcaaagaataatccttgagatcaaagagacagcaaaagagtgttgtagaaaacagacattaataagaaacataccaggcacagaaacagaagagagattccattttttagacttaagttaatcaattctcattgagcacatactttatacaaagtgtcagacaagtgctcaaaggagtaaaatgggtcattagtgaattttcaccacagaaactactttcgctcactttcctctacttcagctcattatccaaaatacattgctgcatattatattaaccttgttaaacatattaaatctgtaccttcttaaaatgacaggaaaaaaacatacaagttttgacttagtatacctctccttaatatttgaccctcattcttcactagtaatagaaacaaaaaatgtgcctttcttgtattccctatctctatctgaagcacaagcacccaagccatgaaaccagacaacatcctagattccttcttctctttctacctccaatttaataggaagtctattcagcttcttaataacccatattcagtccctctgatcaatctcactgacaccgtccagatttccacactcgattttgcttcaaatagtttcctaatctttagatcatggacctcttacacaatttttgcctcatctgtgccctataagaatcatagttattatttaaatttatttttaaaagaaacttggtatcagcctcataaataaacagtatcactttccatatattaaaaaataaaataaaatgaacaaacaatacagttactaaatcctagaaacccaggagtagattggggggataccctggctctgaccttcattctcttcagccttccagtatcaggagattacagaaaagaattaatcctttactcctttcccaaaaaaattgcatctcagtttaacatttaaggatggccagacacagtggctcatgcctgtaatcccagcactttgggaggccaaggcaggaggattgtgtgagcctccgagttcaagaccaacctgagcaacacaatgagacctccatctccacaagatattttttgaaaattagccaggcatgggtggtatgtgcctatagtcccagctacttgagaggctgaggcgggaggattgcttaagcccaggagttggaggatgctgtgagctatgatcgagccactgtactccagtctgggcaagagtaagaccctgtctcaaaaacaaaaaaaaataagtttaaggataaccaaatagccctagttgatgagcaaaagctcatttgtacaaaagcatggcagccaatcataaatgttaaaaaaaaattagaaaaataacctctttgcaactcctaataaaataactgactcaggcaaggatgctaaaacacacaggtaaaaggttaatgggaaactagatatataggtatgatttctaagtattaccccaatactcacttgctcttacaagggggaaaataatactttctaatattatttacaagctgtcacctttactcaatttaagtactaccaaacattattggcttccttatatgatgctatatgagatatacaagatcacctataaagaatactataggctgggcatggtggcttgagcctgtaatcctagcactttgggaggccgaggcaggaggagtgcttgagttcaggagtttgagaccagcctgggcaacatggggagaccctatctctatacaaataaaaaagttaattaggcatggtggcaatcacctgtggtcccagctacttgggaggctgaggcaggaggaggattgcttgagctgggaaggtcaaggttgcagtgagccatgatcgcgccactgtacacgagcctgggctaccaattgagaccttgtctcaaaaaaaaaaaaaaaaatcatattcctccctgcaaatgtttaacctgaaattaatctatcaagatcacctacaaagtattctttctccccaaaatgtttaatctaacccaatcaaagcttttagatataatttccagttgacagaaactacgagttagaaggcaaaagacaaccagaggaaacaagtcaacatatatgggatgctacaggacaacagcctggcctcctctcttcaacaagtcaatgtcaagaaaaagacggctgggcgcagtggttcacacctgtaatcccagcaccttgggaggccgaggcaggtgaattacctgaggtcgggagtttgagaccagcctggccaacgtggcaaaacttcgcctctaccaaaaatacaaacattagccaggtgtggtgccaggcacctgtaatcccagcctgtaaagtagctgggacagctacttgggaggctgaggcatgagaatcacttgaacccgggaggcaaaggttgcagtgagctgagatcgcatcactgcactccagcctgtgagacaggtgagactctgtctagaaaaaaaaaaaaaagaaaaaggggtggagggaaaatgggttatattctaaattcagaatatagagaaaattaaatttggagaaaactaaaagtcctaataactcagagcacagaggactttttgggcagttaaactattttgtgagattttataatggtgaatacgtatcattatgcatttgtcaaaacccataggatgtacaacaccaagagtgaaccctaatgtaaactatggattctggatgatactgatgtgtcaatgtagtttcatccatggtaacaaatataacacctcgttgcaggatgttgatgatgagggagactggagaggggagcggaggtcctaataaccaaacctataacagtctattgcttttgatcgaatcttgatttcaaggagcagttggaggacaactgaggaagtgtgaatgtgtattagatgataaagaggaacttctattaattgtgttatgttgatgacatatactatggttatatagaaaagtatcctgaaattttagagatgcctatttaagtatttaaaggtgaaatatcctgatattggtatttaccttaaaatattttttaaaaagtaaatacggcaaaattacttaaagtgttaagtctgggtgttacagactgcatgtctgcgtcccctcaaagttcatatattgaaccctaacccccaagggaatggaattaaaaggtgggcctttggagatgactggatttagatgaggtcacaagggtagagcctgcatgatgaacagggtgggaccgtatctcaaaaaaaaaaagaggaagagaagtttctattagagcttgctctatctgctttgtgaggatagaggcagtttcgcaaaccaagaagaggaccctcactagaatctgaccatgccagcaccttgatcttgaacttcccagcctccagaactgtgagaaataaatttctgtcatttaaaccacccagtctactgcactttatatggcagtccaagcagactaagacattagataatgcatatacaggtattccttaatagaactaaagagagtaactgtatcaatattagtatgagtcctacctaaaatacctcttccttcacttgcagaaacactggattagattattccaattgcctcagtgttcttccacccttacccaatccagtccaatctccggagaaaaatatgatcacatcactagcctgcacagcattcaatcaaccacctctttaatggggaaaagtgtaaattccatagtgtagccatataaggcttttcgagatctgcccagactccttgagccactctatatatacttcactcatttaaaactcagcgacaatcctacaagtaggtgaaattattattccctctttacagataagtaaaggggaatataagtaaataacttgcccaagaccacacggttggtaagtggccctgcttgactttaaattttgacagtctgatatatccataaaccagataaatccataattttaaccacaatattattctgtgcccggtacagtgtaggtgctcaataaatgcttgctagatgagtagtgtggaagagcttagctctcctttttcacctgatcccaaaagaggagtgaatcctaaccaccctgtttctcttaagagtcaagtcaagtaagagctgatgactgttactggcattgcccgggcgtctagtattgcagtatccccgcccctgtgaggggtgcaaaaccttttctgatttcatttctttggtggtggggatcggactggggaggaatgaggggtcgcagaacacaggctgcccgctgggcccgggggctgcggggagggacggctctcgtgcgctgagtagttgactcgcccactgcagacctcagaagcctcacgacccggaccccgggagccccagccccgcgccctcagccccgcgtccaggacctgatcctggattgccaggggccctcctgggaagacggggccactccgggcccactcacctcgtcccggcactgcttctggcacatctggcaataccagcgtagcttctgcagccccttggacttgatcctgttggcgatagccttgggagtaagaaaatccgacttccccatggcgaccacggcagcgatcactttctggaccccagtactcagccagccggaaacggaaccgggctggcggcggtgggcgggacaaatcccagctgagaggcggaaggaggtggggcctgggaagactgggttgcaacggtcgcgagactcccctcgccgtagcgcgaagaaacgagactgaagaagagagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggtatggcagcttgcgggaagatcggcaggaccgcaagggatggaagagcttgggcacggggcagggaggaggagatgggcgcgggggcagatgtggggtcgcagggcctagctgggcccctggcccgtcggaggcgccgggtagcgggggctgcaggaagcggctctgaggtcgggcaaggtgtgcgcagggccgggctccggcggagcaaggtcccgcccggttccctgaggtcggagggccacctgggacctcgggactgcggcctgagtccaaattgacgtctgggcggtcttgagttccctcagctaatcagcacttcctgagcttccacttccactgcaagccaggcccccagtctcagggcctgcaaggtgacgggagcctgagcaatagcccaggggaaggttaagtcgtgctttttgtccttgacgccctttgaaaccctgtagtgctggacagagtgaccctttaagattcgatcgagtcagagagcgcggccgtcgagcacctcccgtgttgcagacgctttgctgggtgctgcaacagcaaaggcgaacatcctagatgcctctgagggtggttttggtgcagaagggaccgtacagatctgtctgagggcggggaagggaaggacacctagcactaccttgaaaccacttgctgaaaccgtaaccctgcaaggtcatgaaattgcccccaggtcctgggggaggagttcggtgggcttttaagtggcatttgttaactgacatgcaactaaagggtgccacgagcctcgagaattttaaacattagttccgggtagggggacctgggctgggggaagtgcatattagaaggcccgggaatgggcaggtaaaagttggtttgtgggtggtgctgttcagttttgaagcttgacggaatctggaagaattccagacacgctgctaaggggattctaggctgtgtcgtagcaattccctgctcttaacagtgtggaggatttctaaggcgctacagtgctaaactagattttcgtatcctaatttatatgaagggaccataaagcattagttgaaataaataggtttttcattaagcaaataactgatagtaatatacgagattttcagaatgatatctgatgtgaattagccacataaaatttttggtggcttggccttggaagtcagatttttttttctctaatatggaaaaagaacattcatgggaattaaaaggtcactgtagttgaattctcagttgtatagattgtcccacttgttaaccactcagcagacattagctgagtgcttccactccacccggtggtacttggaaagtgcccaaatgtgatggtgagcaaatagataaggtctcagtcagtttcctgggacagtgcctggcatgcagtggtgctctgcgaacatcagctctcctggccttaccttcttgccacgcattaatgttatctgtcagtatttttacaaccttagtttctaagttgatctttaaaaaagtggaaatagtttctgaaacaaagacaatattttacaaaaaattttagaaatatctttttttaaagcacctgtaagataatttgaagctcttttagtgaaggattgttttaaataagagctctcagttcaagacaactactgttaggagcttaaatcggaaccacaatcagcatataaaggtcctaatcctgaccttaatccctttggaatattggttttataaatcatcaatcaacagtgttccactatgaaagcatattctgtcttcttcttttcatgtattccttcactgctggtgcttaatgtctttccttcctcttctgccatttctctttccatgaattataattgccttttgaattcagaaattaaaaccactccacagaattaatttggaaggggaagaaaagacctttgtcttaacgaaccatgaagaggcatatttccatgcttctgtcttgattactggaagttttttaaagtacaatttgttattttagtttttgttttcagagaggctaccatgctaacataaaaacattaggcttacttaaattcacagtggttattttaatagttgttagggtatcggcaaaatactctaacgttttgaaaattaaaccttttttttaaagcagcatataagaaaatggaaattaaaaatttgagagaaagaatcccggattttactgtcttcaaatttgggaaaaacatttctatttcttagagttcagtagtctctaaaatggaactgttttttaataacgtgtcagtagtcataaactacagataccgataaggagatggcatttcaggagagaaaagacaaattgtcatctgagaccatgagggcagatatttactaataaatgtaaaaaatgtgaggcagcagagtgtagtactgtatgaagagagagactctgtagccagccctgaagggctgcattcagacggcagggattgaattctgattgccacttagcagctctgtgaccttgggcaggttactcagtgtctgtcccaccagttcctcatctgtcaaatatatgcaataaaagtgcacaattcagtgggttagtgtgaggattagagtatttgcaaagcatgtaggacaatgggggaaatgctgatagggatccaaatgctgtatatcagtagagaaatgaagagtttttaagtacagtttctacatcaaatgtaatgtaagaagattgcttggacttgcgaaaagaggaaaagaagatgcagtcgggctaggcgcagtggctcacgtctgtaatcccagcattttgagaggccgaggcgggcggatcacaaggtcaggagatcaagaccatactggccaacatggtgaaaccctgtctgtactaaaaatacaaaaattacccagacgtggtggtacgcacctgtagtcccagctactcgggaggctgaggcaggagaattgcttgaacccgggaggcggaggttgcagtgagctgagatcgtgccactgcatttcagcctggcgacacagtgagactccatctcaaaaacaaaaaaaaaaagatgatgcagtcatgggtgtgggttaggtaagtgtgaaggagtcagtttttgctggtggcaggtaatggacttttacacgcttaatatcagaattagagtcacttcataattttcgttgagaattagccaatattgcttgctttttaagtttttatgtatcttaatatactccttaaaaatctctcaaacaatagtttcttggaagggtgtcattcctgactccctcctccactgccttcgtcagctgttataacagcgctgtggaatcatggtagatagtggtaatccacggtccatttgattctccctccactgtgtttcttagtctcccgaggatctcaggacgtgcaatgattcagagctttatctcctcatttgcaaaacttttatatttaataaaggaagctatccctaaagagagttcaattagctcatcactgttcttactcaaattgtacctaacaattaaagtagtaacatagacgtcttcagaattaaatgaaagctaaacatgagagtgctttaaaacacatgaaattagggcaaatgcgtagcattatcacaaaagatgctacctcttcatacctctgacttggagtacttaaggaaaccaaaacattctgtgtttgtccaaatatggtattcaattcaaatttataccatatggtattctctgactagaaacttgtgtcagttgaagtgtctgcctaaaacaataatatccaagagtgacttgttataaccaataaattttgtgttcagggagaaaagtcattactacaccaaaaaaggaaggttgaccaaaaactggtattacttttcaagtgtgattatgaaaagctgttgtagtagaacagtcatggcaggtagtttgtgctctgaaataacagagcttgtcaggatttgccagcttttatcttttcctttagtagattcattcttaaaaccaaacctaatatttttcgtgctgtagtgggagaatcacctgagcccaggaagttgagactgcaggaagccatgatcacaccactgcactatagcctgggtgaggggagtgagaccctgtcttcaaaccgcaaaaaacaaagatccactctttttgttatacagttccacggatttggacaaatgcataatgacatgtatccaccattacaatatcatgccaaagagcttcactgccctaaaaatccctcctctactctccccaaaaccctgacaaccacttctctcaactattgctagatcctcggcttttctggcatgtcacatagccagaatcatacagtatttgctttttttcagatggccttctctcccttagcagtatgcacttaaggtttctccatgcctttttataacttaatagctcctttgtggttttggtgaataatagtccattgtatggatgtatcagagttagattatccattcatgtattgaaggacatctgggttgcttccaacttttggcatcatgaatgaagctgctttacatgctcttgtgtaggttttatgtggacataacatttcatctcagttgggtaagttaagactaggtttaggtttgtaaaaagctaccagaacatcttcccaagtggctgtgtactattttacattctgccagccatcaatgagagttccttttgctccacatcctcatcatcatttgctggtcagtttcttgggttttatccattcttgcaggtgtgtagtgatatcttactgttttaacttgcagttctctaatgacatgatactgagcatcatcttatgtgctttttgccatctggttggtttttgtttttgttttttgagacagagtcttgctctgtcatccaggtggaatgcaatggcacgatctctgctcaccacaacctccacctcctgggttcaagcgattcttctgcctcagcctcctgagtagctgggattacaggtgcccaccagcacgcctggctaattttttgtatttttagtagagacggggtttcaccatgttggtcaggctggtctcggaactcctgacctcgtgatccgcctgcctcggcctcccaaagtgctgggattataggcgtgagccaccgcacctggccctgccatctgttgatcttctttggtgaagtttccagatcttttgcccattttttttatttgggttgtttgttctcttattgcattttaagagttgtttgttttggatacaagtcctttatcagagatgagttttagaaatattttctcccagcctgtggattgacttttcattctcttcacagtatttttcacaggacagaagttctaaatttcaataaagcccaactcatttttttctgtcatggatcatgcttttggtgttgtgtttaaaaactcattgccaaacccaaggcacctggattgtctcctgtggtatcttgtagaagttttatggtttggcattttatatttaggcctgtgattcattttaagttaatttttattaaatttgtaaagtcattgtacagattaatatttttgcatattagtgtccagttgttccagtgccatttgtttgttgaaaagaatatccttttttccttgaattgcttttgcttttttattactgtaactttagaggaggtcttaacgtcaggtagtgtcagtcctgacaatattgtttgacttttctaggtctttggccttcctatataaccttgaaaatcagtttattgatatccacaaaatagatatcaactaaaatcaaacttgctgagattctaatggatttttaaaattgtaaaacacatggaacatgaagtttatcattttaaccatacaattgtgtgcgggcatttttaacttcatactccagtagttcagggctgctgcagaggaatgcaactagctttttatatacactaaccttatatcctgcaaccttgtcataaatgcttattggttctaggaggggctatttttattctttgggattttctacatagataatcatgtcatctatgaacaaaaacagttttattccttcccttcaaatttctatgcctcttattttcttgtcttactgcattagctaagacttccagtatgatactgaagaagagtgatgagtggggatttccttgtcttgttcgcaatcttatggggaaagctcctagcctctcccattaaatcagagattttgtgtgttgttttttttttttttagcaggttgaggaagttctctattcctagtttgctgagagactttttcatgactgggtgttagattttgttggatgctttttctgcacctattgattgtatgattttttctttaacctgttgacgtaatagattatattatttgattttttaatattgaaccagctttgcatacctggagtaaatcccacgtagtgatggtgtataattatttttaatacattgttggatttgatttgctaatacactgttgaggatttttgcctctaacctatgctcatgagagatattagtcactgtccaccaaggtcattcaattagagaaaccttagatcattcttactgctttcctttctactacgaatgtacatgtgaagaagttaaatgcttgcaaatctagtctcctattgctttgccagcatcttcatccaggttcttgaggtctctcctgaggctgtggcagcctacatccccatgtcttctgtgttcatcaaaactccaacctcattttacgcttgtcactgccatgtgagatactttgctgaaatactaaactgatttgtgggcttataaacattcatttccctattaacctacaaataagatttaaaccaatttgctttttttgatatttaaaaatattaattatttaaagtaacaaacccaactcatgtgtccagtttccccttctccatttctcactctttcctgatcatgaatgctcttaaaatgacattctgttcccgagaatcccctcctcacatctctactttgtgcacacatttcatcatgctcagttctcctgtgtagctttgcctgcaaacacaggcactttgtatggatttgaaggcagaaagatcatctaatattttttagcatgtcttcccccattaggccaggaattctctcatattcatctttcaccaacatttcatttaagcctaatcattttgacttctgcacattagcatttcaattttaaagacttgaaaaaaaatactaaatgttatgtaaatgtaattttttatgaaccttgtttacaaggtaacaatatgtcagagaccatgtcgtgtttaccagtgcctggaatttagagcatcttggtaaatgtttattgagctaaattgaaaaagttaagaatcagtttatataaactacttttacacgtgtagtcatgttcgactatatcattgactctgttactggaagaggttgctgtgaactaaggaaatttttagagtggctggccttgattcgaagtatagttgggcagcttaacaaggggaggggcttttctgtcatggaaacaagataagcaaagatatggaggtgggactagagcatgtgtgagtcaatagagcatgttgacttctgggaaggtggtggtacagacaggccaaataaaaggaggccttcaatacagggatttgcgccactactaagggatttaaatatatgtctattcatatacattctgagtcctgtatttgatagattgtttctttatggggtattctttaaataaatatatattaactgaaagtttttcttgtataatggaactatttttcaaaaaactgaaacatttttaaaacttttatcctcaggattcaagttcgaaatatggcaactttgaaagatagtaagtatgttgtttgtctcaatatgtgaattgagaaaaactaaattttgacaaatacaaatactttcaaaaatatactgctttagcccattgtgtatttgatcaaaactgaccaaatggatttccattgtatgtttgggacattggacttgttctgaaaagaccagtaagaaaggacacctgagacagctatgttctgttgtttgtagaatgatcatgatataactagaaaaaattataccagtgttggtgtaggtgggtgtatgtgtgggaaggggtaaatcatgttatatataaataatgttatggaatatgtggttaaggcaactttcaataccatttaatgttttaaatgtatattattgtcttatgttgccatttgcttgtcctaagtagtagctagttttgccttccttttattagtactatttctattttttttttttggagatggagcctcattctatcacccaggctggagtgcagtggcgccatctcggctcactgcaagctccgcctcccgggttcacgccgttctcctgcctcagcctcccgagtagctgggactacaggcgcccgccaccacgctcggctaattttttgtatttttagtggagacggggtttcaccgtgttagccaagatggtcttgatctcctgacctcgtgatccgcccacctcagcctcccaaagtgctgggattacaggcgtgagccaccgtgcccggctattagtactagttctaatattaagactggtttagcatcgtgctgtttattgtttatctaagcgctcattattctgccttgcacttcagaaaaatatgtcaataaattcacaaggaagttatactgtaattcctttgtcttaacacagtacttctatttttcagtcaccaggagactaaagtccatcaaaaacatccagaaaattaccaagtctatgaaaatggtagcggcagcaaaatatgcccgagctgagagagagctgaaaccagctcgaatatatggattgggatctttaggtaagggaagagtgtaattcacaaattaggaagaactgtttcacacaaggaagactactgatgacttacatttagagcttacagtgatgtcaagcctatctgagcacttgccatgtacttatttttcatctacatccacttgacacgtaatgataacaacccgtgtaggtagtacaggtagggactgttagaatccctgctttccagtgagaaaaactgaagcacacagaagttaagtaacttgcctaagatcacatataaaaggatgaagagcctctgtttggacctatgtggtttggtgtcgagtctgtgtatttgttagccattatacgtgaccatgttaacttttaaaatattctgaaatgttcccagttgttaagtataccatcagaagaacttggaaaccgtgcgttagatgtaagggcttaatttcatcctatgaccttgtagtgtggcattttaggactgcagcgggggcgggtgaggggcagtgcagtggagagctggccttgtggtcatggatatgactcatgatggtgttttgagaatccgaacgatgttgaagcaggaaaagcagctgagaacctccattttcaagatacttaatcaccattcttatcttttcaaaagcatgaagacatttttccttcagaaatttatgtaatccatccttaattagtcttcttaatggaaaagagatgagatatgacagtttaaaaagaatttatattgtgtttttagatgcttttatacttgtttgattatgaattcatcttggaaataaagttgtaaagagctggaaatgggaaagaagtttctattttaacttgtaattacattctttctcttaacttttttatgatcatgctgtcttatcctgagttgaggctatctaaaagaatttttaacttaaggaagatttatgcatatttgatagtaaagaagatcatgcagtgaaccccctatttatctaccaaatcctcagtatctcaactgacagctgtcctttgtttttttatgtgtgtgtgtgtgttttgttgttgttttttgtttgttttctttttgtgtttttttttgagatggagtctcattctgttgcccaggctagagtgcaatggtgcaatctcagctcactacaacctccccctcccaggctcaagcgattctcctgcctcagcctccccagtagctgggattaacaggcccccaccatcacacctggctaatttttgtattttttttttctgagtcggagtctagctctgtctcccgggatggagtgcagtggcataatctcagcttgctgcaagctctgcctcccgggttcacgccattctcctgcctcagcctcccaagtagctggggctacaggcgcccgccaccacgcctggctaatttttttgtattttttagtagagacggggtttcaccgtggtcttgatatcgtgaccttgtgatccgcccgccttggcctcccaaagtgctgggattacagacgtgagccaccgtgcccagccaatttttatatttttaatagagacgggatttcactacgttggccaggccggtctcaaactcctgacctcaggtgatccgcccacctcggcctcccaaagtgctgggattacaggcgtgagccactgtgcccggcctcagcttacagctgtcctaagaacacctgcttacactaggcagttgccagctaaatttaaatgcgtattttggaaataaccaactgctttgtaaattagagatttattgtatttagtgtattgcatataaaaaaattactgcttttgtttgtttttaagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttatgcttgttggaattggtgacaaaatcagaggcatactttataggtaatttaaatatatattgtttattttcataaagatgtaagcacgaataaatcttctctcaaaagttttgacaaactctcaaaaccttcatcaataacaaggtatattcttcagggccttttttggtatattcacaagggggtgtttgtttcctttttcttttttccaggatatattggaacatttctgttttccttcccctgttttctacctttgcttcttcatccggatcataagttgaatgccatgtgaatatcaaaagctatcagcattaagccaaatgaggcatctgaggagctgttacagcctggaaatgttagcaatagttcattaggattagaaggagaggaataaaggggaaaagaatataaaacagacctcatttttagttcttagttctttgcaggtgctgaaggaaaggaatgatgatagtgtgtggaacaactcaggaaatcaccaccacccataccccaaaagacctgatccatggtgacaatgttttctcctgcctgtcccctgtgctctttcagcagaaatcttattaaactagctatgtgagctcttgcttttcttataggactcattctgaccagtttctggtggcattcaaagaagtgggaagaaagccccccacttttggagatgcgtcagtcattgcccttgaattactaaattctggatatgaatttgatgaaggctccatcatctttaataaattcaggcaagacagatttagaaatcaaagcttttttatgttcatgcttttgttcatattttgaaataacagtttaaaaattattttgagatttacatttgtttttgtcaattctaggtctgtcatctcctataagacagaagaaaagcccatcttttcccttaataccgttgcaagtgctggtaagtagtttttctatgatacatattttttggcatatagaatggagagatttgtacactaaggcagacagtgtcaagatatctggtggtagctatagcaaatgatttggggctgtttcttttttagatggaatcttgctgcctcccaggctggagtgcagtggcaccatctcggctcactgcaagttccgcctcctgggttcacaccattctcctgcctcagcctccctagtacctgggactacaggcacccgccaccaagcctggctaattttttgtatttttagtagagacggggtttcaccatgttagccaggatggtctcaatctcctgacctcgtgatccacccgcctcggcctcccaaagtgctgggattacaggcatgagcccagccttttatttttttattttttattttttgagacggagtctcactgtgtcacccaggctgaagtgcaatggcatgatctcggctcactgcaaccttcgcctcccgggttcacgccgttctcctgcctcagcctcccaagtagctgggattacaggtgcacgccaccacgcctggctaatttttgtatttttagtagagacagcatttcaccgtgttcgccaggctggtcttgaactcctgccctcaagtgatccacctgccttggccttccaaagtgctgggattacaggcatgagccactgcacccggccgatctggggctgtttctgagaagtgccatctcttgacttccatgatacttaattcagtcattgtttgataactcctgctctattctgtcattaattgaaaagtcagtatctattgaggttcatcattagatttttttgtcctcaaggattgaagagcgtagctagaaactggctttgcaagttatgtttgggacctctaactacaataaaacagaagctctagaatagagagttgaacagtgttcacagctaatttacattgactgactcaattctcttgttttattgttggaataaagtcatcattgatcattgaagcatcctggaataatattctggaactgattttagttttctaaggcttttttcccttgtatataccatctattttctaatacttcatttattttcaagtatgtactttacacgttaatgtttctgaaattgagatggctctaccagccaatggaacatcatttataattgagtacatttttttctctcttaatgagaaataaagtaggtgttacaaccagtaccatttaatgaaatatagtattttgataatatatagtactgtgtcaccacttgaccccaatgaatgaattttgaaatgtacttctaaatttctacaacattaaaactacgattcataccaatttctagttctcccactctttcatgtgctttgaaaggttttccctctctcattttccagattgatacattcagatttcttcagtaatcaaatgactaagttggaattactgcacaggttgagtatcccttgtgtgaatgcttaggaccagaaatgtttgggatttcagaatattttcatatttataatgcagtatcttggggacaggacctgagtctgtacaccctatacacatagcctgaaggcaattttatgcaatattttaaagaattttctgcatgaaacaaagtttcaaatgcaccccatcacacaaggtcaggtgtggaattttccacttgtggcatcacgtcagtgctcaaaatgtttcagattttggagcacttcagattttggactttgggattagggatgctcaacctgtattacactaaattcgtttcaattcattattattcttttttactggaaaaagcattgagtgcttgctggctttgtaacaggcacatgctaatgctgtccagagggcttcataaccacgagatatagtgcagttatttcaaatgttgacctaatttttctaaagttacacatgtggagtagaatatcaaatggtttatttacacattatattttgctaaaaatatgctatcatctgtagtgtggaaatagatgacattattagaacagattcatttaccttatctagcattaatttctgctctgtaattataaaggagttttacactgaaaagctgtttttgatgaattactattccttccatataacttgaaagaaactcatcacttgttttaacagacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttgtaagtacacagtatggacagtgccagcaggagtgcttgtgagcacacagtgaatctcagctgagaggagtccgtggccgagagtagcatcaacaacattaacatgatattcctgtacctgtaagaaagtatatcttgataggtagttgatttgcaagtactgtgaaaaggtatcctatggaagatgtaaaaatatcttcataacattatttgagaggccaattttggtatccaaaaatttcttacttttaaattaagcaacagaagttagttaacaagttattctactctagtttcagattttttatgtagtgtttttgttttgtttgtagctgagatgattgacaaattgacattgacattcaaccgtacccgccaagctgtcatcacaaaagagttgattgaaattatctctggtgctgcagctctgtgagtaattgtagattgtcgccttcagagaattttttttcctcttgctgtgtctgcttgtttggatgcttaaaagtttttcgtttttttcttttgaagttgaaactcattgctgaaacttgcatcctaactcttaggctataaagatgtggtaaaaatgggacctctttgctttatttttattgtttcagctggaaacactcgggcttagttttcggttttctaaaggattaggaatgggatgtggataattcagtatcatttatgaaatctttttttggaatttaaacaattgtaagccaagctttctgagttacagggctagtttcagatttggttttacataaatctataaaccattgcatgttgggaaggtccaggaattttttaatcattatgttttttaatcattatgttttctatatcagtaccaaaagatagtatagccatccctcagtatctgcagtggattggttccagtactcactctcacctcccccaggataccaaaatctgaagatcctcaagtccctgaaataaaatagcacagtactacatataaaaaatgcacatcctctcgtatacttttaatcatctctagttataatgctatgtaaattgttgttgtattggtttttgtttttattattttatcattatttttgtcttttttccaaatattttacatcggctgttggttgaatccatggatactgagggccaactatatactgctttcctcaagaaaatttcttagttgttgaaaaactttaatgtttatgaaaaaaaggttaagataatgggaattttattcaaaaagttattaagttgaatacccactatgtgcacagtacagtgctagacacagtgttaaggatgtgattctctcttttaaggcacttatattctaataggataagaaacatacaagtaattgtgattagataaaacgtgtagtaagttctttttgactcgttccttcttacctcctgctaatcagttaccatgctctttaagttttaccttctaactatctcttgaatcttcccccttctttatgcccacttaatgcagatccttgtcatttctctcctgggttcaaaaaggtaattatttgagtgccccttaagtgtcaggccctgtgctagacactgaggatacagtggtaacagtatttgccttcagagagctcagtcttcacagtaaaggcagacactaaataagaagtcacagcagaacagaggttgctaaactgtggcctggagctaagaatgggttctgcatttttaaagggatataagaaaaaggagagtgatagcgtgtgacccacagagtgcagaatacttgctgtgtggcccttcaccgaaaaaatttgcctattcttgtgacagtgttatgaggaaaataacaaaatccattctctgttatacactcattctgcagaaacactcgatgtatgtgatcctatattttctggtcaccagcactcttcccagtccagtctcttaccattaccatttctcacgtccttgaacctcagccaccttgatctacttccagatctacagattcgtcactctttctcgcggccagggagtggcatgtgctgcagcctgaaaagccactatttcttcccttgctcccttgattcttcatctgactgcctcctgtgtatccttccttactcagctgggggaatcctttcttccagaaaacactccttccttcagtctgagtgaggcagccttctgcagcatcctgtcttccatttagcttagctcttacagccttgtatgaggaattggctttttatttgtctgtgtgctcctcgaggctaggatgggaccatatcttattcacttttgtgtccccattgcctggtacatacctccttcgtgaatgttgaatgaatgaatgaaatgccatatgtattcagaactggaagttcagaagagggacaaataacattttattgggtgtatgaaaatgtgggtccatggttttaagagtcagggaaaagttcatcactatttaaagtgttccttaagtgttacttttcaagggcagaaactgggcagaatgccagagagacacaactagaactttttgagccaacagagacctttgtgtaagttgttagttggatccatcagcctcgctatcctaagcattcttctcttattttactttctaagcacagctgtgttaggactaacccattcacagcctggtcaccaatgttctatcagcatcacagaatactgtctcatggtgtctagcttgatgaacttggttaggatactctctctgttactcagctttgtcatctgtaacatggggactaatacaaggactaaaaccttctattagccattatccttcttgccatctaccccatgttaaagccaggctgatttgttcttggatcttaagtgtgacaaagcctgcgggaaggaaccacattctgaaggtttgtgggctgtgtgagatccagagaacccaagggggtttttttgctcttgacaaacgaatgttaggtatgacctatgatgatacaacttctgcaaaattgaggaccagcctatttcttcattagaaatgcaggaaacctggccgggcgcaggggctgacgcctgtaatctcagcactttgggaggcagaggtgggcggatcacaaggtcaggagattgagaccatcctggctaactcggtgaaaccccgtctctactaaaaatacaaaaaattagctgggcgtggtggtgggcgcctgtagtcccagctactatggaggctgaggcaggagaatggcatgaacctgggaggcggagcttgcagtgagccgagattgcgccactgcactccagcctgggcaaaagagcaagactccttctcaaaaaaaaaaaaaaaaaaaaaaagaaatgcaggaaacctatttaaaagtaacagaaacagctgggtgcattggctcatgcttgtaatcccagcattttgggagaccgaagcgagtggattgcttgagcccaggagttcaagacaagcctgagcaacatagcaagaccccatctctacaaaaatgaaaaaattagccaggcctggtggcatgtgcctgttgtcctagctactcaggaaattgaggcaggaggattgcttgagcccaggagttttaggctgcggtgagctatgatcgtgccactgcacaaaaccaagaatttagaaaaaggaatccacataattggaaattgagtattaagtttttgcttcctaggaaggtagtctaaatccttatacaaaaacttagctatgcagtgccaaggttggattgcttgtgaatgggtttgcatgctctgtaacctatcagttattctgaatcaagacttgaatatttaaacatacttggaaaagaaaaagatcaaaaaacaaaataaacatatttggctatttagtaatataattaagaacatgagtaaaccatagtattcgaggtccaagtattagttgccagcctaaaaactaaatatggccaggcgcagtggctcatgcctgtaatcccagcactttgggaggccgaggcgggtggatcacctgaggtcaggagttccagaccagcctggccaacatggcaaaaccccgtctctactaaaaaagtacaaaaattagctgggcgtggtggcgggcacctgtaatcccagctactcgggaggctgaggcaggagaatgacttgaacccaggaggaggttgcagtgagctgagatcacgccactgcactccagcctgggcaacagaacaagactccatctccaaaaaaaaaaaaaacctctaaatatattgtgttaatttatagaaaaattgtaatttaaattacatattcatagtcttgcctacttgcatgagcatgtttttattgcttctaacctggattgaaatctatgactttttataacagtcattgagtctgtttcaaaggaatcttgtggtaagtatttttgcatgatgtactcaaggtatcaagtttaacaattgactttttttcattggaaagcatatgtgattaactagcatggattgcttcttgacctgcttgttttgtgtttgtctttttcttctaatataataaccagggattaatgaaaatcaagttccatcctcagacaagaggtaaagttcacacattcttcccatgtctgttcagaaaagaaacctattcagatataagttaagctaatttagtaatcctagaattgtcctctgagagatttagatggatgggccacttcacagtagcagccaactcacgggagcacctgggcaacgctagtggacttttttgtagtgagtgtgttgatcatagaaaatgtagatataaggaaataaactttgaggatagagaattaacattattttgagatattatatataggttgtgaagagtggtggttgtcacactttatggtctctggaccccttaatgtctgattcatgtagcagaagccagctagattttcatctgtctctattcattttgttgtgatgtcatggatcatgtggcctctggaaaactctactgtatactcgagaatgagaatataacaggcaaaataacattatcatgaaaatagttttgacctcatgaaccccatgaaaggttccccagaccaaaattttagaatcactggtatagggtaacactttattgtgtaaattcagttctctgtaccccacttaaatatgtattattatctcttgacattattttcccaaaaaatgctgtttgatttcttacttgttctgtactttgtttttcaggtaaagaaggaaaattcagccagttgattttgtttttagcttactgctgcctttgtccgaagaaactgttcctccattatttgaattactgaagacagcaagatatttgtaaattatcttaaaataaacaacttaaaataaaatcattgtttttcttatatataagaacaatagatatagtttttgaaatgagatgatactaaaacatttaaaaatattaatatgctactattaaaattttttagtagaagacaatttaagaggctcttttgatttggtagtgctccactgaccttaaaatgtctagcctctatggggacaacgtagagggaaagggctgcagccacagcctcagcccagttctgtgccttattacagccttaaagaacagtcaacaagaccaggcacggtggctcatgcctgcagtcctaacactttgggagactgagactcaaggtggatcactggaggtcaggaatttgagactagcctggccaacatggtgaaaccctgtttctactaaaaacaaaacaaaatacaaaaatggtgcacacttgtaatcccagctactcaggaggctgaggcaggagaatcggttaaacctgggaggcagaggttgcagtgagctgagatcgcgccactgtactccagcctgggcaacagagtaagactctgttccaaaaaaaaaaaaaaaatgccacaggaagcatttgcttggaattctggatacaaaattgcaagcatatacttactctaaattatttaaaacatcttttctaaacactgagaaaagtacgatactcacatttagatcacaattaagattagatgcctgcgttgactccacactctgagttggccatgccaaaatttcaggcttttccctatttgtttaaaattgataacttagttttttgggttttttttaattacaaaagtaatatataaattccaaaatacataaaattataaacaatataaaacccattcttaacaagctcctcttttaaaaacaaatgaatgcatgtatttagaatggattctttaaatatttacagctatattcgtggtaatgaataaaaaggttcagtgaactgaccagagcttcaaagtcattttctaactcccctcaaagttttcaggagccacttctgaaggggttggtggctgagactaggagaaagaaacagctcacaactgaggaatcagatggaggtgtagtgtgaaccagtacaagataccttttgggaatgttagcaacgaaccacgtgcctctggaggctgtgtgtatgtgtgtgtgtgtgtgtgcacgccactatacctggctaatttaaaaaaaaattttttttttagagatggggtcttgctattttgcccagtctggtcttgaactcctgggctcaagtgatcctccttagccctgcaaagtgctggaattacaggtgtgagccaccatgcccatcctgttttgtattttgcttctaagcttggcttgacccacctccagtttctaggagagcagaacacatttgtgagggtgatttgagtgtcctagacatcatggaaggaggaaaagcaggaatttgaaatcagtcaacataagtaagaataatctgtgtctgaactggaatactagctcagcccttaacagctgtgaccttgggcaagttacttaatctttcagttttatgatctataagatggagattaaaagattgttaggattaaatgagctaatattttaaaatatcgagaatctgacagggagtaagtgctatattcttggttaaatgtctgctctatgtaaaattaatcatcagctccctgtagcctttagtggtgctcttctgtgtactggcactctgactctctgaggatacaataacaaaacgcctccttgcaggagcttacagtctggagggaacacaagcaaatgacagaatgtggtaagttacaattggtgagccacaagagggacagtgactcaatttggggacagatgaaggggactgagaaggccgtccagcttggaggaagggaggtctaaacagtcctcaaggaccagtgaccaacagtagaaattaaactactagagctaactggtggggagggaaggcatttcaggccaaggaagcagaaaaagcaaagaccaaaatctgttcaaatgcacattctgaaaactgctaatacagagaacgagaaaggcaagataaatctggaaaggtgagtgtaccatgctgtgtggtttagacatgtaggaaggaatcaaagagtaagcttgaaattttcccccaacttctgtcctctccttttgctaagtggcataacacagtggaattacagtgataaatgaccactggtaaggtttattacataattcaaactgcttttttttttgagatgaggtctggctcttatcgcccaggctggagtgcagtggcaggatcttgacttactgcaaacttcacctcctgggctcaagccatcctcccacctcagcctcccaagtaactgggactacaccatgcctggctgatttttgtatttttagtagagacagggttttgccatgttgcccaggctggtctcgaactcctggcctcagtgatctgcctggctcggcctcctgaagtgctgggattacaggagtgagccactgctcctggctatcctattttctgcaaacacctacacagtacctaaagggctaggtctgttaattttaatattctaggattgagtttccatcattacaactgttgtctataatgtgccctttaggaaactgtttctctgtgtgctttaatatagaatagttgaagctttcagaaattttattatcattattcaaaactctctaaatgaagcttaagaactgtgcagtcactgagctcctggcaccaactgaagaaaaagtgctgccgttggctgaagttgggctcactggtcctcaactgtaaccctcgtcagcattgaccgctacgccccagtactcgcctttcccacattgctcttggttcttttccttgtccaccaagacagaatgataaggatcaggcctcttggatgagtctgagctctgatctcaggaagaaatttcgttctacagatctcatgccccgctaagctgtgtgcagtctcactgctaaagaagcagctgctctccatttctgccactcctgctcttgaacaggttcctgattcctggcctccactgttcacttctagttactctcttcaaagagtggcttcactgagacatcatccacatgccatgaaattcacccttctaaattctaccactcagtggtttttcatatattcagagttgtgctctaatccactctctatatcattgcaagatgaattgtgctaaaaggcattactgaaatatgactaactgctaggtactatttactagtgaatgagacgaacacagatcctgcctctacccccgcaaagtatacagcaaagaatggaatgattttagtttcggacatccctcaaacattaattacatttgagtgatatattggacatccaagcagacattagtcattagatgcagttagctacgctagtatagcactcaggaacaatccaagataaagtgttatattaaggagtcatctttacacagctaatgatgaaatcactgaggtgaatcctatgaaaagagaacactgtaaaagcagacaaaagctgccaggcgtagtggctcatgcctgtaatcccagcagtttgggaggccgaggtgggcaaattgcttgagcccagcggtttgagactagcctcggccacatagcaaaacccatctctacaaaaaagacaaaaatgagccaggcatggtgacatgtgcctgtggtcccagctactcaggagcctgaggtagaaagattgcttgaacctgggaggtcgaggctgcagtgagctgtgaccaggcatgatggtgcatgcctgtaatcccagctttttgggaggctgaggcaggagaatcacttgaacctgcgaggcagaggttgcagtgagctgagatcgtaccacttcactccagcttgggtgacagagcaagactctgtctcaacaaaacaagcaaacaaacaaaaaaagtaataaaaggcaaagacattgcaggataagtcaaatctttgatattgaagccaggtttctcactttgggagagacaggatatgcaaataggacatgggaggagaaaagggatatgtaattttagacttgaattagaggcatctgtgtgtactttgcacttcaaaagtacacatattgctgggtgcagtgggtcacgcctgtaatcccagcactttaggaggccgaggtgggcggatcacctgaggtcaggagttagagaccagcctggccaacatggtgaaaccccatctgtactaaaaatacaaaaaattagccgggcaaggtcgtgcacctgtaatcccagctactcgggagactgaggcaggagaatcgcttgaacacgggaggcagaggttgcggtgagccgagaccagccattgcactccagcctgggtgacagagcaagactccgtctcaaaaaaaaaaaagatacatattttttagttctttccactacaagggccctgaagcaatgatttccctgtagtaatgaaggtcagctagcacacgtctgggttctaaataatattcctttctaagaagaaccagggctcctcagagagatgtctacttccaagcttagagcaagagaagcacaaggtgagcctggaaaatctagtggcaccaaatagcaagtcctccatgaatgatggtgacacagtacaagaatacagtggccggctggaaagggctcccactggccaaatacgggacaatttaagcagcaagagaatcacgaaggtaatggatcatgacacaccagctaaagaaaagaatccgtgctgggtgcagtggctcatgccttgtaatcccaaaactttgagaggccaaggcaggtgggagttacagaccagcccggccaacatggtgaaaccccatctctactaaaaagacaaaaattagccaggtgtggtggtgcacgcctataatcccagctacttgggaggctgagacaggagaatcgcttgaacccgagaggcggaggttgcagtgagccaagatctcgccattgcactccagcctgggcaacaagagcaaaactccgtctcaaaaaataaataaataaataaataaaatgtaaagccataaaaggcatttggggacaatgggaaaatctgaacacgcactttattttgtgggatattattgtgtcaatcttagtttgctgagtgtgatcatggtattatggggaggtgggagctgtgatgcaccatccagatcccccttcagaaggaccttccactgggaatggtggaagcacacagcccccagctgccaaccctcgttggaattgcctcagctggagatcaccttgcccaaggtcatggccccctccggaagcacctacatccagtgtctgatcagtatgagagtataaagaccccctgcctggctcaggacactgcaaagggccattccagccttacagctctctgtgggcttgactgaggcctttgtgagctggagcccaatgtctccctatcccagtcctgctctctcccctttcccgtccccccctttcccatcccccttcctctcccttccacctttcctcctcaacctctccccatcccttcccctccccaagcccctcccttctcaacactgcccttccctagtcctgcttcctgcctgccctcctcttctctctgccaggcggtgaccccaagagccctcctctgaggttaatcttcatctcagagacagcctcctggggagtccagcttgggacatttggtgccggagaggtctgaaagagcagatgcaagatgggattttggagctggattcccccactggctggcggtgaggacttcagtatgggtggtggatggagcacagaggtgctacctgacacaaggcagcagttcctgaatatgcaagtcttaaaacttccaccaggggtgaacagggtagtaaaacagtggaagcaagctgggacaatgtatgaatgtaccagatatttgagaaatatggagctcatgggaccccaaaaatcatagaaaccaggtggcaatacttaactatttagcagtctgaagccaagtgaatgcagttatgcgtgagagcaatcagaggggtgtgggcttacctggtgagttacggggatggttcatagaataaggggtccctgggcgaaatggatggacgccaacacgtgggctactcaatctggtccatcaaaataattcaaggatgggtagtcgggggtgagggcagatactcccataaccagtcatgattccatgccccattcctggatccaagccagctttcagactgaaaccctattgactgaagaagaggctgagtcttcaggaagaagaatgctgcagcaccaaacggcgaaggtaatgatccccccactccttttgcaaaagaacctacgaccattactcaggtaacggtccactggggaaagggaaacccacacattttgaggaagctgagaatgaaaccaggagatgcggagtcatcacgagtcccttgtcagagtgggggcatctgaggccaagtggcacctggagtcttggcccaggctcagctcacacttagacctactcagtggccaattccctgattcctgaatgtgtcactggaacagacatactgggatgttggcacaacccctacgctggttctttggcccataggtaagaactttgggcatgggagggttgaggagatgactttgaaactgcccctgcagctggggcggggtgggcagaaatcatgacctaaaggatgctgaggctgtgggtcactatattttcatttcatctgacagtctggctcctgcaaatatgagatgcatcttgaagggtgagagtgaactgttgtaaacttagccaagtagtaaccctggttgcagttgctgtgccagatgtggtgtctttgctagaacagatagacattgtctcaagcatatggcatgcggtcattggctggtgaaagttgtcttttccatcccaaacagaaaggatcagaaatagtttctattcagttggaacaggcaacagtatacattttggtcttgtcctagagctatgttaattctctcaccctgtgtcatcatacacagacggtccccaacttaacgatggtttaatttatgattttcaactttgcgatggtacaaatggaatatgcattcagtagaaaccacactttgaattttgatcttttctcaggctagcaatatgtggtaccatgctctctcatgatgccggacacaggctgtgagccacaattcctagtcagccatgtgataacgagggtaaacattcattgtgataagaaatagatatatactctgggtatggatttgcctttcctgctcatcttgtttgagccactgggttcccatatcacgctatgtcagcctaaggggcccattttacaataaaggaaacgtgggagtgggcacaaggctatgaaacccacgggtcatatcatacaccacaccactcagaagctgtcagcctggcagagcaatggaatagacttttttaggcacaatgaaagcaccagcacacaggcaataccttctgaggatgggcctgatcccctaggctgctgtgcactctttaagccaacaaccttttttctttttgtagagacagggtctcactgttgcccaggctggagtgcagtgactcgatcatagctcgccgtagcctcaaactcctgggctcaagttatcttctggcctctgcctcctgagtagctggggctaatttctttatatatatatatatatatatatatatatatatatattttttttttttttttttttttttttttttgtagagatgggggtttcactatgctgctagggcttgtcttgaactcctggcctcaagccatctacctgccttggcctctcaaagtattgagattaaaggcatgagccactgtgccccaccaagtcaatgacttctgtgatgctgggttcccaataagtagatgacacagggtggagactggggtttctccacttacatcactcccagggacccacctgggaaattgttcttcctgtcctgccactctgggttctccaggtttacagatcccatttccaaaagggggaatgctttcaccagaggacctagcaggagtcccactgaaacattagctacagttgctgcctgggcacttccactgagactgcagctaagagaggagtcatctttaggagggggatgggctcctattacagagtgggaggcaaggtggagtgtttggtttccacatggtctgtttgggtgcctcttgcccaattttgggtattctcttccccagttctgatggtacaaggacgagttcagcagccacagtctgaaaagggcctggaaaccaggggctcagacctgcacatgagggtctgcatcatgccaccaaataagctactgagaccagaagtgagagaaatgtaggcctgaggaggagaatactgagtatcagctgaggcctggctgcagcagtcggggctctaatttgtctcctgaccttcctctttaatgttttccccagggaaagggccccctccagaatcctggaggagctgttcctcaaaccaagaagtgtctctgagggtaaaatagatgaactgtgatgaatgctctaatccactgctcagagccccctcaggactgaaggacttcagctgtccttggaattgaatggactcagctgcagtgttcctttgcctgagagcacacaccctttcccaggtagccctcatgcagtgacctgttcctatgggaatataaaggtccagtcttcttgtttggattcagggaagctctgaagggccactccagcttctgcacactatggcattggcttggctgaggctttcttgccaaggaattcactgcaccctggctttcactccttcccccaagtcccaggaggatccctcaatgaactttctgcaggctcatctctatttcagagttgacttcctggggaaccaagcctgtgacatatggtcttgtgtatagttatgtgggggaatgttcttgttttggggtgatacatgtcgaggtgtggtggggttaagtgtcatgaagtttgcagcttattttcaaactgctggaaaaaaaatacctgcgtgcatatataaatacaaaatatatagtaaattggcaaaatgttaacaattggtgaatctagttgaagtgtacacgtgagtctatgattttgtttcaacttttctgtaggtttgaaattttccgaaataaaatcccctcccctatacacagaaaggcaaatgaagaggaacaaacacccagggtggcggcggtagcgggacagatttgtgaaatccaaggcgcaagagagtttcaatgttacagaagcgttcaacattatcaaatagctacaaaataatcaagtacggctaggactgaaaaatgtctcatagatttagcaacacaatgttcctgataacttggggacagagtgtccagggagtaaatgcaggcaccttgccctttagtaccttgcttctctgcagatcgtcatttagctgaagaaccataatttcagttctattattgagtttcccagactttgaaaaatgtgaatatcatgttcaaagttctggaatagtccctgtcggaggaatatagagccactcataaactcgcaatttattggaggagcacataaactaaatacactgtgataagtacagaagggcatatttaagaaaccgcatagttcagccactacaatcgggcgacctgcaggctgaatctagactaaccgtgggatcagtttggcttttgagatgtgttcccaattctgtatttaaaaatcaagatatttatccctaaatccgatttctggcaatacttggatggagctgggagaaggctctggggtaggcaaccgttcccaggacactcggcctgcgacaccggtttaaggctcggtttggcctctgtaggcagccgaggtccccatcccccgataggtcacagccgcgatgctcaaatcgcacactatagcccacaggcagcttacctgttttttttaaaaaaaaaaaaaaaaaaaaagttttattggaaccagggctgggattagaatgacatgagtgagtcaggagtttatggcatggatttggatttttttaaaaaaactgttaaaatattatcgatcttgatgactgagttttttgaggcccccattaatttggcacagagtcctcctagttcctgccctattgcgaagggctttgaagggcatgcggaacagcttggactttatttaatctttgcagtggcaagcagctcaatacacagatttttagctgaggcaacaccagcgcaggtctgcgtttggcgagctccgtaagttcccacgccccaaacttctctctagcacataactctctaatatgactaacgttattagtgctaactctctaacctgtcaatgtcgtatcccagatccctcgtttgcctctaaaacactggcgttttcgtcaccgctgtcccccaggtgagcgccccagcacctgccgccctgggcgcctcctccacctgcgcgccccacgcccgcttccggccggcttccaggcctcagaggcgatcccgaggaatcgttccgctcccaaggggcggagctttctcatcgccgcgctcggcattcggcttatgctgcctcgccccggcggccgtccagcgggaggcggagcgagtccaaaatggcggctctcaggctggcgcgctccgtgctgctggggctttgaggtggtcgccgggggtccgggggaccctttccccgccgcggaagccctagaggatgaatcggggaccctgctaaggtctggcggcggggctggagagcagtggcagcaagggctgcggtggcgtccacgcagcgggatgtgcgagagttactccaggtcgttgttgagggtctcggtggcgcagatctgccaggcgctgggctgggactcggtgcagctcagcgcctgccacctcctcacggacgtgctgcagcgctatctgcagcagctgggccggggctgccatcggtactctgagctctgtgagtaccgggctgggtgcgggagggctgccccggcaagtcaagggtgacaccttcgctctccctgtccctccgcgtccccggggtgtgcatcccgcaccccgcctcgagatctgctgtttcctcggcctcccacgtccctgggcttccactgccgctccaaactctagtcatccttcgggtgcctcttccttatccgctaacttcccgccaccagcccgggagtcgggtcttcgctcccagctccacaccctcctaccgctcctccgctctgaattgtgtctggatctctctcattgtctcctgtttgctgcgggtagatccacccccagcgtgccctacaccctcttttacctcggtcctttttctcccttgcccgcaaactactacaactagttgtcacaggcgctccgtctaccggccgtttcttacaagactggccattcctgggctcctaactacatagactcgttgacagctctgctccgttagggacactgcctcgtctttctgtatctgttcgtttcgtgaacgacatctccatttactgtttttccaaggctgactttgtcagtttcgctgattagatgtactttcacttacgtctcggttaccagtgagatgtcagtggctatcgaagtaggatagagggaccgtgggcagttgacaagattctccaggtaatctgggctacagtacttatgagttttaaatgaatgtctggtaatatctatagctagtggtatttaataatttaatggaaggaatggaatattttaatagaagctccacattatcttgttgatgtgaagcattgtatgtgtgtttgttgaggagaggaaactaccactcattttagtttcaagtcatgatgtttaaggtggtgagctggagaactgaatgaagtgtttcataggatattttgttttgttaaagtggttcctatactggaaaattgagactcacagacacacgctgtatttcttaggccccaagtttcgttcccgcttccacagggctgccaaaataatctgtccatagcacagatctgatcctgtcattattcttaaaaacattttaactatacttcgttggttacaggctaaaaatcgaaactcttagcagtacacagttccctttgtgagctagcattttgcttaccttttgccagcctgccatgctaatctgcgaccacgctgagctacctgccttttccaaaatgttttaagctgtccattcctacatgcgtgctgtttcttacctagagtgtcctttgcccgtggcccaccaatagtattacttttattttcagatgcacttatcacttgctctagggaactcatgttatctgctttcataattctgtgcatatttcttttatattatttgtcatcttgttttgtaatcacctgtgtatgtctctttcccctctccaggagaaaaattgattatatttgtattctgtaacctgtagggccattatataataggcacctgagaaatatttgttgaataaatgaatgaactgataaaccactaccctaaaagccacttattgactttacatattgagttccaaaaatgtatatgttttgaatgcttgatttcactgatacttctattactcttcttcttttgagacagggtctcactctgtcgccgagcgtggagtgcagtggtgcgatcttagctctctatagcctcgaacttcagggctcaagtgatcctcccgcctcagccttccaagtagctgggactacagggatacgccaccatgcctggctaatctttttattttttgtagagatgtggtctggttatattgctcaggcttgtgtcaaactcctgggctcaagtgatcctcctgcctcagcatttcaaagtgctgggattacaggcatgagccaccatgcccagctcactgatacatctgaatgtggaaccacaaagtaatatgcgtgcatttttatcttgaaagtacatcaccagctgactactcttctggcttttgtttctttttcctctggcctccgctgcagtggtccttgagtataccgttagtgataggctaggctaggctaggctaggcatagtccagattatgtttgctaccatgtatctttagatattcaaaatgtctcctgaatacatagttacctttactgccatttatacaaaacagaagggagctgccactctatgtgactaggtattccaaagtcatccaggggtcactgcagctcttcagtgtaaaccttgttcctaattaccaagtttccgtagccagtttcttggtttcagtgagaatgagattgtcaggttcattattcccacgtaatttggtgacttttttttaatgctaattttggtatacttattagatatttttagattcttttttctataccagccttattctaaaatcaaattctgtagctccaggttaccactatggaatcttgtattccacccctttaaatcctttctgttgttttaacaaacacttactgagcatcacttacgaaccaacccctgtactaggcattggagacataaaattactaagatacaatccctgaccataaggtgtgttcaagagttccagaatgtcaggaaacaacaaactgatggtgtttgtttcttctaaaagaaatgttctcaagttaaagcaagtattagaagttaccattaattcaaataatgaacaaataatgaacttaagaattgccttagggtaacaatgtctccaagcattcaagggcagatgtctctgtcggtgtcacattatatgttaaatatgttggcatgtactgaaagcaggtgctaaatctttcagactgactcttcaacactagtactgtaatatttttttgcatggtacagggagtaaatgtaaaagggataagaggagagatggctgtaggctatagattctggggtaggattacttcacagaaaagataagatttgagttgagctgtgaagtatggttgtataaaggtatagagtattccagcttagagaatcacataaactaagctgtccaggtgagattaagcataataaaagtaccagtaaggtgttcagctccctatgcagctagttcattccaagggtgtctgagtaaaatgttcaacagagtgagatcaggttatggaaggacttgaaagctagacaaaagaattaaaacatgtagtagaaaacattgcatactcctaagtaggggaatagtatgattaaagtggtattttaagaaaattgtactgacagtgatgtgcataagagattgaagtgggcagaacttgagactatactgagatagtgacagtaagaatagagagaaaggaaaaaaatctgaaatcatggttaaaaaaaaaaaaaaaaggtggccgaaggggacggggacagggttagaaactaccaggttttggtttgaggctgcaaagcatatggaggaatttaagattattatattttttagactgagagagtaataatagctttaataggaatagaagagatgaaatgcctgtttacattcagtaagaagaagagtattcgttttatttattttctttttttaatgcatcacagaagtaacccatacttatagaaaaaaaaaatcaaagactgcagaagtatgtggagttagaagtcagtctcctgcttccaccacagccctcgcctctactgcagcttccacccctcgaactgttaaccattggctgaatatccttccagaggtttctgtatgcattactacacatgcgtccaattctagcaatatttggattctttttcattttacagtgtgatttaatttcagacatactgagtttgaagtgatcaaatttcaggatttcagttaaaaagtcaggatttcagttaaatcctttaggctattgaaaatcagaaaatggaattttcatagacatttttaaagatgtagagaccttaagctctgctaagaataggcataagaaaaacttgcttttgtaaagaaaaaaatctctatatctaactttttatctctgttttatgtggtgttttctaattacatttgaaaatttatagataaattatctttatggctaggcatgttggtggtgcactggtagtcccagctactcagaaggtgaaggtaggaggatggcttgagcctgggaaggtaaggttgcagtgagccatgattgcccttctgcactccagcctgggcagcagagtgagaccctgtctcaaaaaacgaacaaaaaccaaacttttatgatctaagccttctttgtaaatattcttagattttaaaaattgatttaatggtataattcattcaataggtatttattgagtgccagctatgtgccagccactgtttaagattctgcagatgcatcagggaacaacagaggaaatgtaaccaacattgactttgtcagcacagcacactacttatttgatgattaaaaaaaaaaaaaaggccaggcacattggctcatgcctgttatcccaccactttgggaggcagaggcaggaggattgattgaggccaggagttcaaaaccagcctgagcaacatagcaagaactcatctctacaaaattaaaaaaaaaaaaattacccaggcatggtggcatgtgcttatagtcccagctactcaggagactgagaggggaagatcgcttgagcctagaagtttgaggcagcaaggagctgtgatcataccactgcacttcagcctgggcaacaagcaagatgccatctcttttttttttttttttctgagatggagtcttgctctgttgcccaggctagagtgtagtggcacgatctcggctcactgcaacctccgcctcctgggtttgagcagttctcctgcctcagtcccctgagtagctgggattacaggcctgcgccaccacgcccggctaatttttgtatttttagtagagacggggtttcaccgtgttgaccaggttggtctcgaacccttgaccttgtgatccgcccacctcggcctctcagtgctgggattacaggcgtgagccatcgcgcccagctaagatgccatctcttaaaaaaaaaaaaaaagacaaaacactattttattattattatttttggggcattttctgtgtgtcaggtgctgttccagatgcttttgatcatctgtaaactactttgaaatttgttctataatagctaatcatgaatgtggtttttctgtggtgttctggctagttgtctgattatatttaaacttgactttaataatcagcttaaacatgattctgtgatactctttaaaatctattaaattctttccaataactaggttaaaatgtttgattctgagctgcatatttacttactactttttcttaatatttaaaaatatattcgtgggatttcttcaaataatttgatttgcttttcactttgtttcagatggccgaacagacccaattttggatgatgttggtgaagctttccagctgatgggggttagtctacatgaactagaagactatattcacaacattgagcctgtcaccttcccacaccaaattccgtcatttcctgttagcaagaacaatgtacttcagtttcctcaacctggaagtaaagatgcagaggaaagaaaagaatacattcctgattacctgccacccattgtgtcttctcaagaaggtttgtgagtgtttcttcttcatatgttagtgattattttaatggatttttaatcctcttagctttccatgctatgtcaactttataaattctggaaacacaatagaaacatttactgttacttacaaattattctaacccttaaaccaacaaacttgcaactgacattaccaagccgagtcacggtgtaatcaaggtcatgtctgaagcatttatctcctttgtaaagttcaagtagaggaaaacagtgaagccaaagagaagcctttcaacagccctattatatgagaatgggatattaggtaaattagaaaacatttgaaacaaaaagaaaaattggggtagctcttttcctcctcgcttattattcaggccatgagttgaatgccatggctttatactggaaacagtgagtgaatcgtgagtattcagtgacattgtgtagacttctgttttttatcatgaggagcaatgtttattgtttgatcatatagaacttttgattataaaatgatagctaatcaggtataatggtcagtccaattgcagagttcccttttttcctgcataattttagatgttgatcactaagttcactaagattctaaggagatatttaagtaatttctggtctctaacacaagtacacgatattttttcttataagagttggaaaagttgcaataagttctttcattttgtaaaaaattctaaaacctgtatacttcaggacaatgcaaatgatgccagcaattacttttacttatgattttctattgtaaaatatacataacataaatggaccattgtaaaggtgtgcagttctgtggcattaagtatacattgttattcagccatcatccccatccttctccagaacttttgttccctcccaaattgaaacactgttcccattaaacataactccccattctccaccacttccagcccctggcaaccaccattcctttttttgtctctctgaatttgtctattctaggtaccttttataaatggacttggacattatttgtctttttatgactggcttacttcacttagtatgatgtcttcagggttcattcatgttgtagcctgtgtcgggatttcgttgtgtgtttcgttgtgtgtttaaggcagaataatatatgtacattccacatttgtttatccattcactcactgatggacatttgggttgtttcaaccttttggctcttgtgattaatgccgctatgaacatcgatgtgcaaatctctgttcaaattcttgctttcaggtgtttttttttgggtctgtaccttgaagtagaattgctggatcatatagtaattgtctatttaatttttgaggaagcaccacactgttttccacagtggctgtaccatctaagcttcctatcagcagtgcccaagggttccaatttcttgcaattcatttcttagaatcggttctactttaatagcattttgaagtgttacctatttgtctcaggaagtatgtttaaatttggcataagttgttgtacagtctgtgtgtcagggttgcctcatctgaaaaactggacagctactggacctaagtggtagggatttgttgtgaattggtggctcatcatttaggtgctctggatcttagctgcagtgggttctactgaatgatactaacacaccgacagcccagaaccaaaactaggactttgatcataatctacacttaactatttggtccttcttgtcttatttttatagcatgcaaatattccataataaaattctcttaaagtgctatggttatcatatttaaatactagcaaggaaatgtaactaagataacaggtttagattaggtagtgaagaagtatgaaaaacaatttagtgttttttttgttttgttttgtgttgttttgatactgacttctggctgaaattactatattactatagatttttgggtttcttttctgggttatttgaagcaaaaaaagaaactcatttagttttatgcaaacaatataaattataaacattttaaaaggaaaataacaaatcttgagaacactacttttcactttttatctaacacatgtggattaagaaggaaaaatattgctgatttgtaatatatgcatatggtttataaggatgcagtaagtggtaggcagtacagtaagatgcttgtcaaaacgttctcctcttcataagaaaaggatataaaatgcaattctttggttaccatttaaaaatataaccatacaagaccatttcttgtcatttacaatctgaaatatttttttttcatgggtacagcatgttagaaagttcctggtattctgattagtggtgcaaagtgaggtacagaggtgaacccctttgataatgatgctgttcaccatgctctttattttccttttatttccttaagagccacagacaggccagactttggtcttaaaatattattagcaaggtccttccatggggttccctcttatcagccactcagcttggttcatgtcaaaaaagcctgtgaaagtctccctccacagcagctggagctggcgagtgtgcacacatagaaggcctgaaggggcagcaggctgtgagaggcacagcgtggacctcacggcatcactgagacatgactcagcgagtcactgagtttctggtcttcccaagtcactttacctttctgaactttatattcatctgtaaaataagtgtaataacacctaccacattggggaaatggagaatcaagtaatttttttttgttaacacatttatataaaattggacagtgtttaacatataaaatacataacagtgggccaggtgtgatggcttatgcactttgggaggctgaagcttgagcccaggagtttgataccagcctgggcaacgtcatgagacctcatctctactaaaaataaaaaacttggctgggcgcagtggctcacgcctgtaatcccagcactttgggaggcggagacgggcggatcacgaggtcaggagatcgagaccatcctggctaacacagtgaaaccccgtctctactaaagatacaaatattagctgggcgtggtggcgggtgcctgtagtcccagctactcgggaggctgaggcaggagaatggcgtgaacagaggaggtggagcttgcagtgagccgagattgtgccactgtactccagcctgggtgacggagcgagactctgtctcaaaaaaaaaaaaaaaaacaaaaacaaaaacttagctgggcatggtggtgcacgcttgtagtcccagctatcagagtctgtggtgggaggatcagttgagcccaggggtcaaggctgcagtgagctatgatcacaccacagcactccagcctgagtgacagcgagaccctgtctcaaaaaaaaataaaacacatgacagcgaatattagttctcgtcccctttttcttttcttgctcttaaataatttacttttgaattgaaatacaatatacattagtgaagtcacgctataaggggaatcggtgtcaagctgcattcagtggcacacccatagtcctagctacttggaaggccaaggcaggaagatcgcttgagcccaggagtttgaggctgtagtgcgcaatgattgagcctgtgaatgcccactgcacttcagcctgggcaacatagcaggaccctgtctctgaaaaaaagagacgaatcaatgtaaagtagtgttaccatcacgtgctgaggatctgagggaacagacttactagctgggctggataggtacttgactgaggagctgtgtgattatccgcagtgtgaagatgacagatgaggagatgatgtggaaggagttattgcctgctttatctgattatatgtttagaagtgagacctctttgaaaatattttatacatgcatatttttgcttggactgttacagttctgatggctggtacccagtgtgttttatccaagaacattctctccccagcttgccatacatattttcagattcacaccaataccatatttttttgcttcctattttattgtgctgaggaatgtctgaaaatagtacagcgtactatgccaaagtcattgttggttctcacagtgtggtctctagatcactggtcaatgggggtcttctgggggggtctgttgattggttcaaaatatttgcataagaaagaaatataggctgggcgcagtggctcacacctgtaatcccagcactttgggaggccgaggtgggcggatcacttgaggtcaggagttcaagacgagcctggccaacatggtgaaaccctgcctctactgaaaatacaaaaattagctgggtgtggtggtgcctgtagtcccagctactcgggaggctgagatgggagaatcacttgaatccgggaggcagaggttgcagtcagccgagatcgtgccactgcactccagcctgggtgacagagtgagactccgtctcaaaaaaaaaaaaaaaaaaaaaaaaaaaaggaatataaaccatgtaccctgacttattgcaggaaacttaccaagctcaacttaaacttggtaaagatactgtgaggttgccacttttagagtttctattttttaaaatttaaaatagactattttttagaacagttttgatttacagaaaaaattgagaagttagtttggagagttcactcacatctgaaccatttcttctgttattaaccttttacgtgactatggtacgtgtatcacaattaatgaacaatattgacatgttattattaagtgacgcccgcactgtattgacattccttagtttttactggatgtcctttttctgtttctggatcccatccaggatatcatattgtgtttggttgtcacgtctccttagacttttcttggctgtgacagtttttcagacttttcttgtttttgacgaccttgacagttttgaggattattggttaggtatattgtcggatgcccctctagtggaatttttctgatgttttcctcatgattagactggggttatgagatcttggggagaaagaccacagaggtcaagggccatttttatgacatcatatcaaaggtctatcctgtcatcataatttatcactgttgatattgatggtgatcacatggctggggtagtgtttatctggtttcttcacagtaaagtttctcttctatcccctcttcccctactgtgctctttggaaagaagtcactgtgcgtagcccgcccttaaggaatgggagttatgcgtcccgctttgaaggtggaatatctgcatatgttgttaggaactcttctgcatggggatttctctctttccccactaagatttctatttttattattaaaccctttaaaagtaaacatttacatgtttgaaaaaattaacaaaagtaatacaaacttgctgaaaaaatatattgccaagtgaattcgttatgaaatggaagtgtctcttcacttcccttcctcccccttcccaagaataacctagttggcagatggggctcctctgcatcttcccgtgtgaccttttgcactccttggactcaagaatctatgtccacttcagtacctgccatttctttctcaagctcctgccatccttttcttgaagcagttcttgctgtgaacaccaattactatctaaatggttgatctgaaggaaatttaaaccctttctcccagttcaagaaacagaactttaccagctatctcagaatagcttctatgtgcccaaccccaccccaccccttcctccctccctccaaaaataaccaaccactgtcctgactttgtaggaattactccttagctttatagttttatcagccaaatgcgtatccctagacacattaatttaatgttcttcacacatgcacacctttttcactttacatgtcttttttttttttttttttttttttttttgagaaggagtcttgctctgtcacccaggctggagtgcagtggcgcaatctcggctcactgcaaactccacctcctgggttcaagcgattctcctgcctcagcctcccgagtagctgcaattacaggtgcatgccactgtggctggctaatttttgtatttttagtagagacggggtttcaccatgttggccaggctggtctggaactcctgacctcaagtgatccgccagcctcggcctcccaaagtgctgggattccaggcgtgagccaccccgcccaaccatgtcatttaccttttagtttgtgactctccttccattcctttctttgtcttacagtttatttgttagaaatctgggttgtttgatctgcagagtgccccacagttggatgttgcgcattgtgcactcataatgcagctcaatgtgtttctcaaaattggcagcaagaatctgaggcttgaccagatttaggtttggcaagatatcagctgatgatgtccagttttcacttttgttggtgttagcagtgctgatgctcagtgcctagatccattaattcattaggggttacaaagtaatgataatactatcactttgtttttatttcattctttagttgaaataactttataagaaaatccttttcctcatccactatttagtaacttaatggcatagtttatatagggaaagcagggttaacgcttgatttttttcatatggtatattcccagttttcatgagaataaattggttccttgttatccttagcaggtgactagtttcatttaatactctatcattgtgaactcacagatttaaacatacttgacggatttcattcattactttttttttttgagatggagtctcactccatcgccgaggctggagtgcagtggctcaatcttggctcactgcaacctctgcctcccaggttcaagggattctcctgcctcagcctctccagtagctgggattacaggcatgtgccaccacgcccggctaatttttgtatttttagtagaggcgaggtttcaccatgttggccaggctggtcttgatctcctgatcttgtgatcctcctgcctcggcctcccaaagtgctgggattacaggagtgagctaccgtgcccggcctcattacagttttttacccatattgtagctttaattgttgcatctttggccagtggcagcttcttcactcttgcttctgagtccttttgacacatgacccgaattggctttggtgacgtcctcaccttctggtatatcaaaatgttctagactcagcatgtatagtcatgttctatgcttggtataaattatctgtccaggaaaccctggtttcttggaaagtagtatttcttttctttttttaattttaattttttttaattataaaatttcaggttacatttgtatatatctggggggtgcaaagcgatgttatgttttataaatacaatgtggaataattaagtcaagctagttaacatacctgtcacctcaaatgcctatcgttttttgtggagagaacatttaaaacttactctcttaatgattttcaaatgtgtaatacattattatttttctttttcaccatgctgtgcaatgtatcaaaaaaagtactcctcctgtcagattgaggctttgtaccctttgcctatcatctctgtatccccacatccccacatcccctgccccagcctctgtaaccactgttctactctctgcttcttggaatttggttcttttcgtccacatataagtgagaacatgtggtatgtctccttctgtgcctggcttacttcacttagcagaattgtttgaattccatctatgttgtcacaaatgacaaaatttccttctttttttaaaggctgaataataatactttttaatttttatgggtacacagtaagtataaatatttatggagtacataagaattttaataaaagcacaccacaatgtgtagtaattacatcagactaaattggatatttaccacctgaagcatttatcatttctttcttatttatttatttatttttgagacagtctcgcactgtcacccaggctggagtgcagtggtgtgatctcagctcactgcaagctccatctcctaggttcaagtttaagtgattcttgtgccccaccctccccagtagttgggattacaggtgcccaccaccacacccggctaatttttgtgtttttagtagagatgcgatttcaccatgttggccaggctggtctgaaacccctggcctcaagtgatctgcccacctcagcctcccaaagtgctgggattacaggcatgagccactgcacctggcccagcatttatcatttctttgtgctacagatattccagttatactcttttagttatttttaaatgtacagggtgcagtagctcacacttgtaatcttgtcactttgggagtctgaggcaggaggatgatttgaggccaggagttcgagataaaatgttcaataaattattgttgactttagtcaccctgtggtgctattaaaggctgaatagtattctgtggtgtatatatattacattttctttatccactcatctgttaatggacacttaggttatttctgtaacttggctattgggaacagtgctgcagtgaacttgggagagcagaatctcttccacataatcttttcaaatcttttgggtaaatactcaggagtggggttgctggattatatggtaattctattttgagtttttggaggaaactccacatagttttccatgactactaatctaaattcccaccaacagtgtacaaggattcccccttttctccacatccctgctaacacttgttacctttcatcttttttatagcagccattctaacaggtgtgaggtaatatctcactgtggttttatttctgtaatgattagtaatgttgaacattttttcatgtatttgttggcagtttgtatgtcttattttgaggaatgtctattcattttttattggattatttctttctgtagggttttcttttttccttttttggggacccagcaatactgctgatttattacaagtccccaagagggcttcagtttttcttttcaacatcctgttctgtagcttccatgtctctttttgtccatatgtggaggagccaggcattggcacgggccatgcagcaactagcaaaggctctgaaattcttctcctcagtggtgacttgagctttctccttctcatagacattctggatgggcatgactggtcctgtcagctgggtggccaattgcagttcttcagcagaactgtctcccttcctggggaccgagggcttcctggggaagaggatgagtttggagcggtaccccttcagccgctgcacagtgcgtgtggaagtggggcttcaagatcttgccattcccgctgggcaccatggctgcctgctgtcctccggcacaggacaacagccagactgttctttctatagagttgtttgggttccttatatattttgcctttttttttggtggtggttgtggctcttgttgttgttgagttgcttacatgttttgggcgtgagccccttgtcagatgtgtgggtgcacgtgttttcctcctcacccacaggttgtgccttcactctgctgtttcctttattgtgccaaagctttttattttgatggaatcccatttgttcagttttgcttttgtcaccctgcgcttttggggccaaatataaaaaataattgcccagaccagtgtcttacagtttttcccctatgttttcttttagcagttttgtagtttcaagtcttacatttaggtctttattccattttgagttgatttttctaagtggtatgagataaggatccaatttcattcttctgcatatggatatccagttgtctccacgctgggaaatagcatttcaagtacacagtctcggtgctaagggatacttattatatataactcggttgttcattgtttctaggcaataagtaaataaatatttatatacatgtagatgtgtgtgaatagatagataggtggatagggttcctcctgagttcatgcagattttccaattcatatttaggactacaaggtttttattttttatgttacatccataaatactgtcatccatactgagaattctggttctcaggaataaagaagatgataaaattagaatattccataattattcatttgctttatcccagattacacgtacaatattgcaactgatactatcattcatgattactgaaacaggtaaaaaaaattttttttgctcattctgtcctatgaaaccaattttctttcattttaccgtgtgtatcttgtcagatcatatagctactgtcttgagttctgctacctaatttctgagttttttctgattttgatttatatactttcatgtcttttagatcatttcaagatagaacattataggttcatcagttttttcgagtgtgtgtttctctcgtactttcattgtctggagggatgttttgctatttagtcttctcttctttatagaaactatatgtgagttagttttctgagcctttagaacacaggtgtccaatcttttggcttccctgggtcacactggaagaagaaggattgtctttggccacacataaaatacactaacaccatcgatagctgctgagctagaaaaaaaagtcacacacaaaaaagtcataatgttttaagaaagtttacaactttgtgttgggctgcattcaaagccgtcctgggccgcatatggcccatgggctgtgggttgacaagcttgctttagaaggagattcagggtagctcctctgactttgcagtgctccctcttctatcgtttttgcggaatgttccaaatatgggaacttgctcactgagattttttgtttgttttcctccaccacttttacctggatcttctcttcccttcatgtcagttttcctttttctggccagctgtgattccactgccagctgtgtcctctcagcgaggctctgtcctggcagagagcagccagggtcaagtctgagagctcctgggctcaacttctagccccattggatctcactcagccccttgtactccctgtactggaagtggtcccatccttcccagcctcagccgctcttctcgggttggcctgccgggctttccagcagaggcctggtggcccttttggggttttcctgtttcaggtcagtcttcccgttgcttctcactgtttcccttgcatagatgcctcatactcgggtctcatggcgcttggtggcatgttgtcacctgcatgtattttggcactgatgggtgtactctgtcacctggttatgttgggaagatgcacaaactaccttgccccagctaccactttcttcccaggattccccttattgaagctttttgctgctttcatcactgttgggcaattcctgaagctgcttttcttcagcgccatcatactcccttaactctccttatatgatgagctccatcttggggcctttcttgggcacgtcttccctggctctcctactgctaaaacattggtgcttctaaaattttatccttcacctactatgtttctcacgttacttagtttcagagttgactttcctactctcatagtttgaacccccatctgtatgctgatgcctccccaaactgtccctctacatccacctctcagaccctgcaaccagttgcagttggccatttccacgttttcttttttctttcttttttttttttttgagacggagtttcgctcttgttgcccaggctggagtacaatggcacaacctccggctccctggttcaagtgattctcctgtctcagcctcccgagtacctgggattagaggcatgagctaccaagcccagctaattttgtattttcagtagagacggggtttctccatgttggtcaaactggtcttgaactcccgaccttgggtgatctgcccaccttggcctcccaaagtgctgggattacaggcgtgagccactgcacccggcccatttccacattttcttaccacgaatacacctgtgttatccatctcagttggtggcaccatctctactcagtcacctaagctagaaacatgagaattagcattgacctcttctctcattctccttcattccctatctctaattctgctaattttctttcttaaaaaatttccaaaatattattgcatcacttcctttgtttaaacctttatctcttgtctgaactgtccttatcctctaaacgaaactattagacaaaaaattaacacatcccacattataaaacactttgttggctctccaactgcttacagttaccaaaaatacctatggagaggagttttcttttttgcatcaaaatgaaaagagctttggttgagtgtgatggctcatgcctataatcccagcacttgggaggccaaggcaggaggatcgtttgagcccaggaatttgagaccagcctggacaacatagtgagaccttgtttctataaaaaatttaaaaatctggccaggcgtggtggctcacacctgtgatcccagcactttgggaggccaaggtgggcaaattgcttgaagtcaggagttcaagaccagcctggccaacagggtgaaatcctgtctctactaaaaatacaaaatttagctggacatggtggcatgggcctgtagtcccagctactcgggaggctgaggcaggagaattgcttgaaccagggaggtggaggttgcagtgagccgagattgcaccactgtgctccagtctgggcaaaaaaaaaaaaaaaagtcagctgggtgtggtggctcatgcctgtaatttcagcactttgagaggttgaggcgggctgatcacttgaggccaggagttcaagaccagcttggccagcatggcgaaacctcgtctctactaaaaatacaaaaattagctgggcgtggtggtgcgtgcctgtaatctcatctactcgggtggctgaggcacaagatttgcttgaacctgggaggcagaggttgcagtgatctgagattgcaccagtgtactccagcctgggcaaaagagcaagactctgtctcagaaaaaataaaaaataaaacaattagccaagagtggtgatgtaagcctgagaggctgaggtggtgtaagtactcagaggctgaggtagggggatcacttgagtctgggaggttgaggctgaggctgcagtgagccactgcactccagcctgggtgacagagtgggaccctgtctcaaaaaaataaaaagggaatagctgtagttattcaagagaaaagatgtttattcttacaacgtagattacttactgatttaatagaggaatgttaatgaagatatttgcatggctttcagttgctaaaataatgtttgtgtatgtaaaagcagccatcaaataatttatccttgatatcacataatatattcataaacattatctcatttaatcttgaaacaggtcctaaaggcagatgctgctatcattcccatttatggaaggagaaatggaagtttaaaaatcataattgaattaacctgcctcgtgttgcattgggaattgggagcaaagctggattagggtttagttgactccgttcagtgctgtgtgtatgggtacctgccatgagtcggatcctacacaaggaactggtgttgaatatagagagatgagtgagatattcctctctccccattttggcctttctgctgttgtttggaagtccctgcttggccaggactgtcctaagcagaagagtacctttaccaagccagttttgtttttttttgttgttgttgtttgtttgtttgtttgtttttgagacagagtctcactctgttgcccaggccagagtgcagtggcctgatctcgactcactgcaacctctgcctcccgggtttgagcgattctcctgccttagccttccaagtagctgaaattacaggtgtgcaccaccacgcctggctaatttttgtaatttttgtagaggtgggatttcaccatgttggccaggctggtctcaaactcctgacctcaggtgatccacccacctaggcctctcaaagtgttgggattatgggcgtgagccactgtgcctggccaagctggttttcttaatgggcaggcaggcttcttgaataccttctggccccctaacatccgacgctataagcctcctccacacccagcctcctagttaaggatctggctgcctctctcttggccctctcagataccttcctgttcattaccttgttaggctggagttccagggtctggggaacgttccttctgtgtatctagggaagttgtctggaggcattgcttgtttttttttttttttggtttgtttgttttgttttgtttttaaatccagcagcatctgagccagataattgcagctgaaatcgtaccaagggctgatgttgggatatgcctgtggtgttcagtacacgtgtcttagcataaacctacagggccctgtgtgatcggactcctgcccacttgacatgttagttacttgcccctcgttgcttcgtgctttaccttccagaatcattaaactgctgatgtttcccaaaaataactatgtacctgggtcagctcatgctggcatggagttctcgtccatcaccatgcccaccctggcttctttgagcgcccgtataatatatatctctaccatcatacttcatatattttgttataattgctggttttatttgcctctgtaacttacccaggtcttgctttctctttaagtcctacactcattctccatttcaccatttttttggcagaaaacctatggtcctgctactctatgagagttgaattcaagacatggagaaacttactgactcctgttcttagggaaagtttttcagaataatggaggagcagtcgcaaaaattagcttgtccaaagtcacatggctgcgaagtgatagaggtgacagtgggatcccaggtttcatagtcttggccccatcttctgtgtatcattcatggccctggcattattctcaagggcacagatagaagaacaaaggcttgtattgtggctcttcgtttgtttcttttcctttcaaattggtttcttgagtacaattattttttttttaattgtgttttgttaacatcttattcttctattcaggttactttttctgcttattcttgttatcctcaggaatgattttttactgacagcataaagattgaagtagatcttttagaaatctctgtgtctcttgctttacattcaggccagcaagatttagcgcctcagcggaggtgtatacatgtcagcagtcagcatggagagtagaagtcccagcatacacagattgagagggactttacaaatttaaatggactttgccaaaattctctgcctttcaaaaaggtttttcctttaatttatctggatttataaaaacagaagcacatttccaatgctatagtaagagatttttggatgggggagtatttaagggattgaaaaattttttttttaagttttaatgtttctaaattaacaaagtaattctatgaagtatcttaggaaaatgagtgttttttttttttcgagacggagtctcacactgtcacccgggctggagtgcagtggcgccatctcggctcactgcaaactccacctcatgggttcacgccattctcctgcctcagcctcctgaatagctctgactacaggcgcccgccaccacgcctggctaattgtttgtatttttggtagagatggggtttcaccgtgttagccaggatggtctcgatctcctgaccttgtgatccgcccgcctcggcctcccaaagtgctgggattacaagcatgagccaccgcgcccggcctggaaaatgagtgttttgatatttactataaacaccaaatttgtctacttctctcttctaggcatccagaatgaaaaaaaaaaaaaagattggttttttttctaaatttagaatttgccagaaatttaacatttctttatctgtgcttacggtttttggaaattttcccacgtgtgtgaggggaagacgggaatatcaaggaggagcaggcaatacatgcttgtggctggctcagtgtaagaccccaaagttagtacttttgctgtaagttaggacttactttgtcttgctttcttgaatttgaatctgaaattgaacagtgtactcattgccttttatttagctaatgactgcttacagccacatagaactttgctatttcatgttttcttttctttctttcttttttttttttgagatggagttttgctcttgttgcccaggctggcgtgcaatggcgtgatctcggctcactgcaacctccacctcccaggttcaagctattctcctgcctcagcctcccaagtagctgggattacaggcacacgctgccacacctggctaatttttggtatttttagtagagagggggtttcaccatgttggccaggctggtctggaactcctgacctcaggtgatccgcccacctcggcctaccaaagtgctgggattacaggcgtgagctgccgcgcccggcctagagctttcctatttcagataaaataatagcaagttatttgcttcttttacggtggttatatactgatggtgtgccattggtgccaaaagtaaattcaaaataattgtttccttccttcattcgtcaaggagctgtggagagcctgctgtctgcaggctcactgcttatttctgaaaagagaggtaaagaaatagaggtccttccctgctttcctagagcttacagtctacttggggaaagaagggctggactcatgtttatatactatttaaaattataatttgggattcttaaaggaaaacagagtgctccagtactataaacatcagaggtctctaacctagtgtgcttacaggaataagggaatcaatggatattttttaagtagggggttaggatgatttcattataaattctgttggtactgagaaggatggactcaagaggagatgtcactggaagagtcttgataaagcttgtggtagtcacccaagggacatgataggaaggaccaaatttgggagatattggatggtcaggatttggagatagataaattgtagaggatgtgctacagagaggagcctaggtttcaagcttgggagattggctaggtaatcagatatctaaatatccagatcttaaacagactggccagatctggagtgagaatttagaatggaccttatagtctgcaggcaatcctctaacaaaactttttatttattttttttaaataatcaggtagagctcaggattgtaaaacatgacacgaacctcgtacccagggcagacttggttgcttatgttaagggcagcaggtacacttgctttaaatcaggtggatggtgggcttttaccaaatgactgcctatgttggccaggcaccacgcccgatgtgggaggcagaggccctcctatcgttcattgagttgcgtgagtaccctatttaattaaagatggccctgtttgtcattgtaggatattgaattaatattgttttttttttttgtttttttttttgtttttttttttttttgagacagagtcttcctctgtcacccaggctgaagtgctgtggcacgatcgtagttcactccaacctctgcctcccgggctcaagcagtcctaccaccagctgggatcacagacatgcaccaccacactcaactaattttttaattttttgtagagatgaggtttcagtatattgccctggctggtcttgaactgcaaggctcaaccagtcttccagcgttggcctcccaaagtgctgggattacaggtgtgtgccaccacacccagccttgaattaatattctttgagttcctagaacagaattgctgtaaaagaagaactaaaatcagttttgttctaaaagattaaacaataaccttaaattttttagatgcgggcttaaagctatatatatatatatttgtccgatgatacctaatggtcactattgtcatgtctaccaaaaatttaatagcttggtatgtcattgaagcgtgacagttcaaagccatgttttaactttctccccaataagatatatctgttatttcctcttccaagcccaaattccatcatttgtaaaatgggaatagtaacctccattggataattattataatcaaattagatataaatgtcgtatatttttacagatcttagatatgattttccaagggcaggcccacatttacagtctgttcctgaaaaatctcagcactgaatgtaatggttgtcatactttgttttctgaagaaacgcttacagtacagtaaatatatgcatttgcaataatatcctccggaattctttctaatctgggaattctgacatgctttgcacctgctagggcgtagtctgtgtctgtctggggcttttactgctttctggttaagtgaggctctcctctgcctttcccatggaactgcgcagaagctgcacaggccagaccttgtgaatatgttcttgagacagggtctttccctgtcacccaggctggggtgcatatagcttactgcagcctcaaattcccagactcaagcaatcctcccacctcagcctccttagtagctgggactaccagcttgcaccaccatgcccagctaacttttttttttttttgtagagatgggctcttgctgtgttgcctagactggtcttgaactcctgggctcaagcgatcctccccactcagcctcctaaagtggtggaataacaggcatgagccaccgttcccagcttacagtcatcttttaaatgtctgcatttgtcttccatcattttttgatctgcttttagttgtagtcatctacaggtttaagtaacttttaatcttttttgaacccttagtcatattgaagatgttttatttaaaatactacttaaatgtagttattcgtatctagttttaccacaggaaaaaagtataataatatttctctctccctgttgtgtgtctcccctatctctttctcactctttttttttttttgagcactgtgatcagtcgttggataattgtgttgcttaattattgatattttgtgcttatgtcacacatacaattaacatgcattaattgattatttctcccatgtaatcagacttggtttaaatttataattcattttcactacatattatgtagtgaaaatataatggttaaatacactcttgttagttaaattttatcatccattttactctttgtggacttcaaattttgcagtataaataagaaaacggactgttttatatggaagtgattacaattcagtaggtggcactctttcaatttctgttagtgttaatgaatatccaattaaatgtcaaagaatgttttaaaatcttgagaaaaagcatacaactttagtcattgatgccttgttttagaaaggatagtaacaatttgttcataatttagcgtctctggaactttgtgagaatagttacgtatgaatatacttaatatttatttgccttgaggaaacttacctaaaacagaatttcttttaataaaggctttgtgatatcctatctgaaactgtagattttctattcagaaatttaaattactgtccattattgtccattttccttccatgttttgatttttaaacattattactagagtcccagtacaacatgctttaaaaacattaacacagttctctcattctgacacagcagcttttcttcttcttcttgttctttttttttttttttttgagacggagtcttgctctgtcaccaggctggagtgcagtggcgcgatctcggctcactgcaacctccgcctcctgggttcaagcgattcccctgcctcagcctcctgagtagttgggattacaggtgtgtgccaccacacccagctaatttttttgtattttagtagagatggggtttcaccatgttggccaggatggtctccatctcctgaccttgtgatccgcctgcctcggccttccaaagtgctgggattacaggcatgaaccaccgtgcctggccagcttttcttctttttagtctatgcctgtctttttccattatgaacataatatttagctagctggatcagttaacacaacttagttttgctctttttattcagcattatttatgttctgcttttttttaacgtatcatttgttatgttttccttgttcctgtgtattttttgtatttcctatttttaaaagaatatgccattagttacttagccaatcgcttattgttgggcatttttaatattttaaaatattgcaatgttgcatcaaatatctttgcacatgtttttcttttatattatttccttatgataaattcccagggtagaagtttttaggtcaaaggtataaacacatttatggtttttgacacatattacccattgatttccaaaagagttgtatcagtttacagtgccgtaatgaatgtatgattacaccagtgtcccagcagtctccctggaatagcatttcaaagtgtattgtttttttactagcttagattaaacaatttgggaggtgtgtcattttgttttaaaatttttagttgaaatgtgggaactaccaaaaaaaaaaaatctcccactggaatataactgctgttatttttttgacgccgccctccaggtctttgtgtgtgtgcgtgtgtgtgtgcacacggttcctgctttagcatagcttaagtgtagtgttgaattttatgtcctccgtttttcgtttaattaagtcacttactatatgctagtcattaatttctatttgctgggcagtgctaggggtaggggtgaacccaaagtgcataaaatgcactgaaatgatttggtttgggtggttctgttagtcacgaaagggtatgtggaagcgagaatgtgtttgagataggtggtaatgtgaaaatatttatgtttgtgaaatatttttatcttaaatgcttgcttggtgaatatctgtgagtattatagcagtatctgatcagatttagagtgaaggtgagaggtctcatctgaaatgaagatgaagagccttactccgtgtggctgtataatctcagcatcattttcaattggccgtgtgagaggccattccttagtattgagcatcttagtcttttctgatttttaacttatgtgaatagcattgctttcttgacatttcagattttttgtttttaatttttatttctatttgtttcttttcaaatgcgttgaaggcaacagattatttcttatggttgaaaaagtttgatttctgagtttaaaaggatgaagtggtttgtgtgtttttgttttttttttttttttttgaggcaatgtctcgcctgtcacccaggctggagtgcagtggcgcaatctcggctcactgcaagctccgcctcctgggttcacgccagtctcctgcctcagcctcccaagtagctgggactacaggcgcccgccaccacgcctagctaattttttgtgttttggtagagatggggtttcaccgtgttagccaggacggtctcgatctcctgacctcgtgatctgcccgccttggcctcccgaagtgctggcattacaggcatgagccactgcgcccggccaaaaggatgaagtttttaaaaatagtttttgataaaatttcttcaaaaagtattgtattaatttacagtactactggtaatatagaatacccattatattctgtcctttcatttaaaataatgtttctaatttgatagttgctttatctgcatttgtgatttttagttcttctggtaccaacatttaacataatttgaggaaagtgttcttaacccttggtgtactgtttgggtccactggctccagtttagttttcaagttttgtttttgaacagttttaactattacagttttgagtggttttgactagttgaaaagattggcatttcatgatttttattctttcctagaggctaacaaaaaaggagaaaaatgatcatttaaaaaaactgaaaaaaattcattctcttttgctgtcaccaaatatccactggacctcctataaagctaagacatgatgagacttcagggatcatatttcctgcatcttgaaacattttactattttatcgttgtaggaattattatcattcatcattactcatcagttatttccaaatatgctaaaaaagactaaaataataagtggaagaatgatgaaatcacctaagtaataatgatacaatagtgaaatagattgtcatccttcattttcttactgtgtgagacccagaacattatatttcaagaatagattaaaaaggactggaaacaccttctttttagtctgcttatagctttcatttgaatacagttgaaatttagaatttttcattttcagcttaaaatggacaagaaaaaaattgacatgtttcacagttattaaacaaatcaaaataaatgcaaagagatagcatttctggctgatgaggattataatggaattggccatataagtgaaatttcagactctgggtcttcagattacaacatcctagaagaattataagaaaattcctctaggatgacatctgataatatttcatatttgtcaatatgaattgacatatgtctaagaacaaacaagaaatatggtctctcatctagtcattcaaaaggactttatcatgcaataatatttttgtgacaagaacctagaccatcctgttctgaaagaatatatgagagtttaaaaatattttatgctgttaagcaccaaaatttacctgacacaaaaggttacatgtgtttaaattcttttttttaagacagagtcttgccctgtcgtacaggctggagcgcagtggtgcagtcatagctccctgaagccctgacttcctgggctcaagggatcttccgcctcagccttctgggtagctggaactacaggcatgtgttaccacatccagctaatttttttttatttctgtagagacagagtcttgctgtgttgccctggttggtctcaaactcctgggttcaagtgatcctcccaccttggcttcccaaagtgctgggattacagatgtgagctaccatgcctggtatgtttagattcttgttaaaacttctttttttcttaattttgagacaagagtttcgctctgtcttccaggctggagtgcactggtgcaatctgggcccaccgcaacctccacctactgggttcaagtgattctcctgaggctgagcctcccgagtagctgagactacaggcacccatcaccacacccagctaatttttgtatttttagtagagacggggtttcaccatggtgtccaggctgatcgcaaactcctgacctcaggtgatccacccatcttggcttcccaaagtgctgggattacaggcatgagccactgtgcccagcctatatttctaataaaattgttttcactatctttttattcatagttctatgcattcttcattaaatggcttaacaatataaaggttccattggagccagatgttaactggtactagctattcttcctgatatactgagggttaaagtaaaaaatatttctcagatttaatggcattattacattttaacacttctctagtgtacagtcctaattatgtctgacatacacaattgggaatagttagaaggaaatcattctggaccaatcagtaatggaatgaaaaactcaggaagtcccaatgccatggtaaaggagaaaaactcctttttcatttcctttcatgtacagtgtgttcagattaactttaaaggagagtgagatgtaggtcttaagattttgtctgcaattgagtattacctgtatatggagcccatctcagcaggcacccagtcatcagccagcaaccccttccaggtccctcgacctggtccctcgacagctgctagatatcctgttgcaaattaaatatgaagcagggatggacttaattttgcatttaaaggatttcttaaagttcagcctcaaatgaagttgttagtgttttcatttttattgaagctggctttgttggaaaggaaggggcagctagaattgtcctcagtggtattaaagaaaaatgctctggaaaaaataaagtttatgcctaaagtttggcataaactttatgccaatatgcctttatatatctatatgccacatttcataactcttcttataaatactgcacagttgtcaggcctgccaaaatggtatgtagcctactgtgtcagtacagcctgttagtaaacatatgtttatagtttaactgtttcccagtagggtgtttttgagactttcctttttcagctttgtctttctgaatggtagtaacaaagggaaataaaacatggtgagtttatatcacactttgagggacaggaggctaaactctagaattaaacttatgaaccgcaacaacacttacatgtttccttaggtaccaagtgcttcacacacattaactcattgaatcctcataataatcctgtgaaggaagtactagtattatctttttttttcttatagatgagggaaataaagtgtagggataacttttaaggtatgttagaaactggtagatctaggatttgaattc

SEQ ID NO: 34 - DNA, 150656 bp, Artificial Sequence
  Synthetic BAC sequence
ctaaagggctgaatctgcccagccactgacttacacctgcatgtcccctgatgtccaggtcaggtataccaggtggacacgctagccacaggcaggggccaagtacctcttcatgcaagatacagcacttggccaggtgcagtggctcacgcctgtaatcccagcactttgggaggctgaggcaggcagatcacttgaggccaggagttcaagaccagcctggccaacatggtaaaaccctgtctctactaaaaaaattaaaacaaattttaaaaattaactggccatggtggtgcatgcctgtaagtccagccactcgggaagctgaggcaggagaatcacttgaacccaggaggcggaggttgcagtgagccaggatagcaccactgcactccagagtgagactctgtctccagaaaaaaaaaaaaaaagacacagcacttatattgaaccagaagtcagaatgctttggactatgtgtttgcttgtgaaattcactattacaatctggatggaccagaaaatgcagggaatgtggcagtcacagcaacaggctttctctctctgggaggaagaccattctttgctagacaatggatacatctaacatacctctctctgcctttgcaaagagagagggagcctctttggatgccaaaatatttggaatattgaggaattttgattgcccagaatattgggcatgtacagtcattataacaaaaaagggacctttttgtgtcgcattcttagccactgatgtgataataatgacagcagctgacatgtatgattgcttccaatacattagacactgtacatagtctcatttactcttcgcaacacctctaagaggtagggagttcattgtccccattttacagatataagaaagctaaaacttagtgaagttgggtaattcgcccaaagtcatgcagctggttaaccaaaatgtgactgaaataactgtcttgatccaaagctcatgtttcttcacaattctgccttccaacctaaaaattagaaccatcaatcccttcaagaaattttaaagctggtttttgcatagtaaagatgaaaagaatgccattataaacataaatggtgaaaggaacaccagaaagtagtagtaaaggaacaccaaatagcccagctaaaaaaaagtgcttcaagagttagaggaaaagcaatgtcagtctgagttaggatcatcagagtgggcttcataaagcaggtgacatctctgttggatgagcttgaaaagatagaggggataatgacgatttttcccaaaaggagaatccaaaaggccatccaaactgggcatcagaaagggagaaacagcataaacagagccatggcaagagaagttcaaagaggttaaactggggcagtgttttccaaactgttcaacaaggtaaccatggttaggtgcagaaaagggtttaacattgatcatgcttggtaagtgttgagttaatcacatttttgcaggacttcttggagcctttagtgaggctaagtacattaagtgcctcatgaagagtgaggatattatacattgggtttgttttcctgatgtatttgactaatagactcccctgcctcttttgctttgatttgttttttgttttttttgttttgagatggagtctcgttctgtcgcccaggcttgagtgcagtggcatgatcttggctcactgtaacctctgcctcccacgttcgagagattcttgtgcttcagcctccagtccttcagctgggactataggcctgcaccaccacgcccacctaattttttatatattttttagtagagacagggtttcaccatgttggccaggctggtctcaaacccctgacctcatgtgatccacctgcctcggcctcccaaagtgctgggattacaggtgtgagctatcaaactaagccaattttttttaatggagaaactgtgaacatctcattaaactggcaatccactgaacgagtttaagaagtgatgttttaataaagggtattcaattaggaaaagaggaagtcaaattgtccctgtttgcagatgacatgattgtatatctagaaatccccatcgtctcagcccaaaatctccttaagctgataagcaactccagcaaagtctcaggatacaaaatcaatgtgcaaaaatcacaagcattcttacacaccaataacaaacagagagccaaatcatgagtgaactcccattcacaattgcttcaaagagaataaaatacctgggaatccaacttacaagggatgtgaaggacctcttcaaggagaactacaaaccaaccactgctcaacaaaataaaagaggacacaaaaaaatggaagaacattctatgctcatggataggaagaatcaatattgtgaaaatggccatactgcccaaagtaatttatagattcaatgccatccccatcaagctaccaatgactttcttcacagaattggaaaaaactactttaaagttcatatggaaccaaaaaagagcccgcattgccaagtcaatcctaagccaaagaacaaagctggaggcatcatgctacctgacttcaaactatactacaaggctacagtaaccaaaacagcatggtactggtaccaaaaacagagatatagaccaatggaacagaacagagccctcagaaataataccacacacctacaactatctgatctttgacaaacttaacaaaaacaagaaatggggaaaggattccctatttaacaaatggtgctgggaaaactggctagccatatggagaaagctgaaacgggatcccttccttacaccttatacaaaaattaattcaagatggattaaagacttaaatgttagacctaaaaccataaaaaccctagaagaaaacctaggcaataccattcaggacataggcatgggcaagaacttcatgtctaaaagcaatggcaacaaaagccaaaattgaccaatgggatctaattaaactaaagagcttctgcacagcaaaagaaactacaatcagagtgaacaggcaacctacagaatggcagaaaatttttgcaatctactcatctgacaaaaggctaatatccagaatctataaagaactcaaagaaatgtacaagaaaaaaacaaacaaccctatcaaaaaatgggtgaagtatatgaacagacacttctcaaaagaagacatttatgcagccaacagacacatgaaaaaatgctcatcatcactggccatcagagaaatgcaaatcaaaaccactatgagataccatctcacaccagttagaatggcgatcattaaaaagtcaggacacaacaggtgctggagaggatgtggagaaataggaacacttttacactgttggtgggactgtaaagtagttcaaccattgtggaaaacagtgtggcgattcctcagggatctagaactggaaataccatttgacccagccatcccattactgggtatatacccaaaagaatatacatcatgctcctataaagacacatgcacacgtatgtttattgcggcactactcacaatagcaaagacttggaaccaacccaaatgtccaacaatgatagactggattaagaaaatgtggcacatatacaccatggaatactatgcagccataaaaaaggatgagttcatgtcctttgtagagacatggatgaagctggaaaccatcattctcagcaaactattgcaaagacaaaaaatcaaacactgcacgttctcactcagaggtgggaattgaacaatgagaacttttggacacaggaaggggaacatcacacaccggggcctgttgtggagtgggggggaggggggagagagagcattaggagatatacctaatgttaaatgatgagttaatgggtacagcacaccaacatggcacatgtatacatatgtaacaaacctgcacgttgtgcacatgtaccctagaacttaaagtattttatatatagagagagagagagagaaaaaaaaaagaagtgatgctttgcaaactttatggccaataacacatagaagaccaacaggaaccattccatggatgacctgggttgctctggtaagatgctctggcactgtggccctagggccctggtggaggttctggatagggccatgccatgagcaattgtttgagaaaatttttctggcaggaaaggcaagcatcagacccaggccaactaatgaagctactgtgcgatccagtggtaaggtggtgagtgtccgaactaaactggaaaacatggtctcttcatccttctccacttctgcagttcatcaacacaacagctttcacgccctagtcaattttctgaggtcattagaaaactgcatctacatggtcagcggggagaaattgggcatcaaaaaaatcccatgaagatgcaggaggaaaaaaaaatcctagaagctagtctgactgatcatataatttccctgcttaaaagttctcaatgtgggaggccgaggcaggcagatcacttgaggtccggtgttcaaaaccagcctggccagcatagcaaaccctgtctctactaaaaaaaagtacaaaaattagcaaggcatggtggcatgagcctatagtcccagctacacgggaggctgaggcaggagaatcacttgaacccaggaggtggaggttgcagtgagctgagatcgcaccactgcactccagcctgagcgacagagcgagactccacttcaaaataaaatgaaaaaaaaatttttttaagtattcaatgggtcctcctttcctttaatattaaaaataaaatagtttccctgccctccaggggcctgtatggcctggccattgtccacctcttctctgcacctctcactctgctcacattcccactgtatccaagtccttgggcacttcatttgactgtaagctccatgaggtcagggggctgtctgcttttgtttatctcataactagcacatagtaggagttcaataaatatttttaagggaatgggtggatggacagcttatttgcaggaacagatgtgatttgttttataatgctttctagcagattccaccgaagtccagtccaatcccccaataacaagattaacaagttttaaaataaaacttagcaactatgcatgtagccctgtttgactttatatctcacatgacctctcctgtttctgtgaatcagagcttccagctggctgggattctatctgtcatttctcagcaggcagaaacccaaaggccacaatctctggttgctttattctttttcctcttcacagatcacctcaggggagacaccatctactatcttcctcacaaaacttcagcgtcttgaattaccttcctgactgcaaacacctgattcatccatttcttcctggaactcttaacttagccaaaattttaggttgtattcaattaggaaaaatcatacaaaatacctattcccactcaattctagattaatcgaaatcttcctgttgagttggttatgcaggtaaaactacaccaccggctttggatatttaaaaaaaaaaaaaacactcgagatagtcaaagccttccatatctagcctaaactaccattttcttctcatttcccacaatatccaccaataaatttacagttcagccactgtaatttctttttgtttttgttaaaacagagtcttgctctgtcgcccaggcttgagtacagtggcatgatctctgctcactgcaacgtctgcctccgggttcaattcttgtgcctcagcctcccaagtagctgggattacaggtgtgcatcaccacgcccggctaatttttgtatttttagtagagacggggttttgccatgttggccaggctggtcttgaattcctggcctcaagtgatccgcccacttcagcctcccaaagtgctgagattacaggcgtaagacatcatgcctggccctagccactataatttctaatcgatttcaatatttagaactgaagattattttatttgtactgctgttttccatttgccaaactcttttatcaccttatggggctgcttgtgaacttctcttcttccttaggccaggcaattcaatgtttcaaactgagtagggctttcagacactgatttttatcttaaaatgggagtcgagagcattttattcctttatttattttttctttgagacagggtcttgctcagttgcccaggctggaatgcagtggcttgatctcagctcactgcaacctccaccttccaggctcaagcgatcctcccacctcaggttcttgagtagctaggactacaggcacatgctgccattatatttattatacatattaaatatatataatatattataattatatatacaaattaaatattttacatatatatatatgagagatggggtttcactctgttgtccaggctggtctcaaactgtggggctcaagcaatgcacccacctcagccttacaaagttctggaattacaggcctgagccactgcacctggccttattgtcactttttctaaaacatatttgtgagaaagacaaatggacgctttaagactccttgagaaatcaattgaacccctgttatgccagatgagcccaaggacatagttttgaagcctggatctgagcactgtgctggacctggaaacacttcactgctttccttgagaaggcaatctctccaatgactgagccccaggcacatccaggaggcttcatagcacaacaccaacagctagcaaaggttgccctgcaactttaggttagcactaaggccagaagtgggaagaggttgtcgccaaacaccttcagccatctgagcagctctttcaacttggtttgtgctgctttgtcctggggactgtctaaaatgaaggacctctttggctgccctctgctttccctctgactcgctgaaacacccggaatgttctccgagacgcctggaggtaaattaaaagttccattcgtttatgtatgccgcccgtcagcactcagtcaacatcagcacatacctttggacattgcccagataagttgtatttgatctggtgacctaaaggtgaattgtaggttatacttaattacactcatgagccaagtccaagtcagtaacaaacctttctatttcactccgaaataccgtgaaaccccttaagggagtccactgattataccaaagaggtttgtatgaaccaactagggtaaataattagactgtatttttaattaatattgcaatgccttccagcacaacgatatttaagatgatgacagtattggagataagtagagaaacagtcttgcgtttaaatcaggaagaatgaaggaagttttgtcagattgacaaaaataccctataattctagcaattttgtgtcaaaagtttccagtgtgtttaaaggaagttttcaatttagtaaatgctctgtttgccatggtgaagatatacagaaaaataaatacagagaaaacgaaaggcaggtagtatgcatttttttagtcatgtgaactttatgggaataataacaattaacacagatttcataatgggcaccatttcaatttttgtttcattaagcttcgtaaaaaatataggcttttgaaaaaagccagttcaattaaagcatgaacttttcattattttttaacacattttacctatttttaattgatagaagtgttacatattttgccaagctaggagtttttcacacttctttaattcaaaccagcttgatttttgcaattcaaatagacacattattatttggtattacctggaaaccaaataaagtaacagtaaaacttattaaatagatcacaatgcatacattatttcctaaagaaatttattttattatactttcagaatgaagtaaatctttttttttttttgtttaaccctagctaaacctcataactccttaatgagaaagacactaataatctacaaataatattttacaaatgaaaaaacccaagcactaaaaagttatgtatcttgccctaggtcacatagcaagtgaaaggtcagaatcttaacactgctattctgaccacttgtaataccttctctaggcttaagataataaacaaattaagcaagggatatgtctttttatttttcccttttttgtttgtttgtttgcttgcttgctttttctttacgtagtattgctgtgctaggcacatgttagtatctcaacgaataatttgtattcagctttctattaagcacagctctctacaacctgcattgttaaacatttatagtcaacaacatgatgttaattatgacgacctgaagacattgcaagataatagagtcacttgaagcatcaaagaaagataaaaatatgttcatctgtgccctgaactgcagattattgatagggaccagagccagggaaactctgggcagaagagggcaggtccccggccccaccttcaagctgaaaagcctaatactgcagccaaaagtgggagtaaaaatccctgttgtccctcttgaatgttgcctctcccaaaaccacccatggcccaccccgtcccccatcctgtgaccataaaaaccccaggctcagccagcagagagaggaaaagaagctggatgaggaaaaactatggttggacactggagagaagcagcttgacttcagagggacagcttgacagtgtagccttggaaggagtccagctggagatgaccagactccaggggaagttcaccttcctgctctttccccttttcagctccccttccagccactttcaccaacaaaatcccccacatttaccatcaccaattcattcatgcgacctcattactacaggataccagacaagaattcagatgccacgagtgcaggtgcaaaaggctgtcacactgaccctccactgagctgttaacacttaagtgatccacagacaggaaagctaaaggagcactgtggcactccttctgaagctttagaggtagtgggcactcccctagatgctgctgaagggcctgcacaaagtttagctcctgccagtgcccaaaagcactctccctggctcctgcacccactcacctgttctccccccgctcccacaaggggtgaaacacagcaggaccaagagagtggagtccacccgtgccagcaccaaagtggccagctagttctagcacccatgcactccagttcccacccatgaagaggtcagggaaataccttgcttcattagtatcaccagttgctggctatgagttgaccatctttatccgtatgtcccaaattaaattgtttttcatcttctacccaacacttctctgtccaagcttcccagctagaaacttgggattcaccttcaactattttattctctcattcaccatccttgtggttatggagtatccattctacctcctaagtatctctcaattctatctcttccctcacattttcactgccctaattctgagcctcattttcttgtgcctagaaaattttaacagcctcattataggttgccttgggtctagtttctcatccttggcgttttccttcccaggtgctcagtgttacctttctgaaatagaaatcactcactttctaaagactgctggcagctgcctctaccctaaagcagccttttctatgctgagatccatgaaaccctgtgagcactatgaaaagggaaagacaaataggtacagggcaagctcttgaaaatttatgatgcagagtagcatattaaagactctgagaagtcctgccggaaagttaaccccaggtaactggcctaccccagtgtttgccacattacttggcctcagaagctccttgtatttccagacaacaccaatcaacacctcgaggaaccagtattcttctaagcatagtttgagaaaacactatgctacaagataaattaaatgtagtaccagctcttctccatggagcacagccttcctaaaccaattacaccatgtttattgctatttaaaaggcaaaagcatactcttgttttgccaagttaagtaggaagttccttcaaaataggatacatttcccccaactttttcatccaaggaacttttactaataacttcaagtcccagccccagtgttactacctgtccaacaccttcctcaagtcattcttggtgcttgctgcccatcagctctttaattttgcaggcgtctgttcgtaagtccaccttccctacaagaatattaggcccttttgtctttggaactgtaacgcctagcacaattcccagcatttagtagacactcaacaaagctggtagaaggtatagtttattgtattctaacataatagcttacaggtagttggtgttgatgcatattcatataaaatttctccagagaggtagaagtgattaaaagaacatataaccccttttctcactgcagctgagataaatggggttttccagagggagatgtgcatgtggccctgctctgtctcaggaggcagatgcctttggctaacccatctggttgttaggtgattgctttccaacatcagctttgtgcataccttcctgcatctgtacttccctagaaggcaattgtctccaaaagaggaagagatcattttcagccacagatatgatgaggcagtgaaagacactggtgtgcctcaaagtatggtcctggacacccactgagtgacaatccatgcccagatgtttatggtgccccgtggcccccaggcttataagcacttcctttctactcactgataggacaaggtctactgagaaacagttattagctgtacgtagcactgaagaaattaattttcaaagcgttgcatccaaaatttgtcaatgatgaggtagatctgtaaatgactctgcccctctccagctagcaagctatttcacctctttacaccacattttcctcatctgtaagatgaggataaatgagacagcattcgaaaacattcaacaccttgtttgacacatagcaggcaatcaataaaagtgtattgcatttgattctgatttctactgaattttatagtgtataaaaataaaaagagaaactacttatataaaattaataaccaactcaaaaaactgttactaagtatattttggacagatctatttgtctttgccattgtcagtgttaaattaaaattaaaacacactctaaaaagcctcctaattcagcagaacagcattcagagttatgcatctgagccatacattttaatgctgactgactcaattatcacccaaggtctagcaatttgagacctcaatgtcattaaggtaaagtccggaaaagacatgttgcatcagtggtatggttctgttataggagagtcggagatcctgcttagaactgagtagaatgcaaacatttcttttgtaaggttggaacctttcccctattattttgtaagggagtaaaatgcatgaggcaatttaaacacgccaggcagggaacgttccacagctcccactgggtatgggccaagtcatacacaatgaagtcctgagccaccatggggtaaaggcaccagctctcaggaacatgggtctccctagcactggagttaatgaggccattggttcacttattttcctttccagatattatcatgatcaatttgcatgatgattatggaaaaattaaaacactattcccaaagatcaagttaataaaggcctttgagactttaagcttcttcgaggagaacagtagattgttctccaaaaggggggaaataatttgagataaactatagtttagttcaatgcaccaaggctgacttcttccccccgccaacttttttttactggtagcatcttccccactcttgagaacctctctcccttaagagcatgtaatgaatttaatacaaactcaaggggaaataaaatgagcagaggggaccaaaaaagagtcaaaatgaagggaaaagaacatgaatttgtgaaatagtcctgtggttgaaaagccatgtggcccttgttctgcccagtgacagattctacactttctagattcaaattgaatatcatttctccttccatatgtcaagccaggctaagagatgaaggacttcagcaacccctccttaggagggacaaatctcatccctagcatctgactcaaggcagttgcttcatttccagggaaattcttgttttcagtttgcactttacccacttcaccctccttttttcagatggggtcgtgctctgttgcccaggctggggtgcagtggtgtgatctcagctcactgcaacctctctgcctcccgagctcaagagatcctcccatctcagcctcctgagtagctggccacaggtgcatgccaccatgccccataaatttttggatttttggtagagacaaggtttcgccatgttgcccacattggtcttgaattcctgagctcaagagatctgccctcctcggcctcccaaagtgctgggattacaggcatgagccaccatccatgtccagccccactttttaaacataaaagcagatactgctggttttttttttctgcatggacatttctactctctgcttcttagaaaaagcagttaatcactttggaagttggtttggagggtaaaatctatgaaaacaacttacattccacctccttctgagagtttcctctttgcaggtgaagtggtcaaaagcccagtagatcaagggggagaagtggcaagtaaacaagatctgcattctaaagatttccctatgatactaccacaaaatgggacaaacaaaagtccaaaacagaagactgtacagctcttccatttattaaggattttacttttaccatcgagaccacctttaaagaataagaagaaggcaaaatagttcaaaccaatattctataccacagctaacattttctgtgagcttttcttggtttctgtatttcagctaccttatctaatcctggggaatcccacacatgtaaaaatgtaaatatccttttaaattttttgtagagatagggtctcactatgttgcccaagctggtcttgaactccgggcctcaagtgatcctcccacctcaggctcccaaagtgctgggattacaggtgtgaaccactgagtccagtctaaatatccttctttaattatttgtcctgcctcagtttctccaagcttttctcataactgtagtccatgggccctccaatcacttaaaaaacacacaaaacccttaatggtttatagccagcaaagccagaaggaatgaaatactgtattctttctcatgatggactcaaagaagaaacatttaagaacacaaaagaatactgttgcagtgactttttacattttacccataatttctctattatgtttttccaatgactaaagtaatctctttgaaaacataatgccatcattttctgcacaacagtgactgtaataaattgagttggaaaacatttactgactatgcacttcgggcttagctgtgctaagggctcacagggccaccacaaacagtggtgtagattgtgcccagacatgggagcccggttgaaggggcagctgaaaaccaccatgttgtcctcccaccgaagccaccattactgactacagcagcctggagaaagggtggcttttttgttatccatctgtctcaaggggcacagtttcctgctaaccttttgtgacaaaggaagctcacggaataagaatacaaggagcttataatctaatggaagataatttcagtgaagggccacataaattacctgaagttccgtctttttgagacgaaaggcaaacagttgagtgatcctcactactccctttatagtttctgtatctgaccaactttttggtggccacactttggtggccccactgtgtgatgttccctttcctgtgtccaagtgttctcattgttcaattcccacctatgagtgagaacatgtggtgtttggttttttgtccttgcggtagtttgctgagaatgatggtttccagcttcatccatgtccctacaaaggacatgaactcatcattttttatggctgcatagtattccatggtgcatatgtgccacattttcttcacccagtctatcattgttggacatttgggttggttccaagtctttgctattgtgagtagtgccacaaatcagagagtgattctctttaccatcccttctgcctcctcatttttaatcaaaatcatgaaatgtacttcccatattgtagagagtaaatgagaactggaggagccctatgaagcactgtgcgttggacaaactcagaacagatgggctcctaaaccttctttcccatacctactatgggtcaagtacaagggcactgtccttctcaatcctcaactctatggggcaggtcctgagctcctttgtccagttcagggaaatgaggctcagagacatgaacacacttgcctcaggctacccagcagctaataagtgaccccaggacaccatgtcctccctggacactaaagtggtttctttccagaggaaggaaaatggggactggagtagggagcctgtgtattcagcattcttctctaatgcccagctcagctcttggcacagggcactgatacttgttgaactgaactcaagaaggaaagttggagaacaacccattcttgagcaggcacctcagatgagacaagtgagggggtgctctctctcgggtggcctcacttgctttacccttgtcccttaactgctctcatgtgagctgccctgctctccctttcttccaccccattttccatcaaccctctggggcttagggtcttttgtttccaagtctcatggataggcagaagttcaaactgctccccacagtctccactctcaccttcccactggcctttctccaggtttactgccgcacctgcaccaagaggcacgaaacccctcaaggaaagtttcccatacatcttcctggtggtctttcatttctttgccaataaggcaatctgcttcacaacacacttcgatatatttgacatctgtcataaaacccaggtcaggcagatctgtcttctgttaaaataagctattctacaaagacacttcctctgctgttagatccccaccagaaataattattgacatattgtccacacgtccagccaaccctcttaatagaagccataaatttctggtgctggtttcccctacttgtatcagagaagcaaggtaacacttagagaaccagaaggaaacctgaaggggaagctctgtctgaagtgactggcttcaaacaaatacctgcctttaacatctttcaaaagttaatgactgtggcaacacacagctgtttcttagtgatggagcatgaattttctcacaacattacactgagatgagtcttatgttcacacagcacagaaaggagttgatagaagttttctgtgcagcggtgattcctctagatttagggtgggctcaacctttagcaaggttctattctacatggggcagaattctgggcactcagagtcccagacatgctatgagtatgagagagcattgatcacttcctgttctcattgatcccttgagaggcacccatacaagtggctggtctcagttttccaaaaacctgccagttggaaaccctgtgaaattgtttgcctgtgtcctcacccaaatctagtcttgaattgtagctcccataattcccacatgttgtgggagggacctggtgggaggtaattgatcactggggcagtgtcccccatactgttcttgtggtagtgaataagtctcaagaaatctgagggtttcataaggggaaacccctttcacttggttctcattccctctcttgcctgccgccatataagatgtccctttcaccttccaccatgattgtgaggcctccccagccacatagaactgtgagtccattaaacctctttttctttgtaaattacccagtctcaggtgtatctttatcagcagtgtgaaaacagactaatacaccccattacaagattgctaagatcaatgctatactcaaaggtgttttagcccctctgagcctcagtaggtcaagtacatggaggacatggacatatatatatacttcttcctgctgatcagttagtaggaaaaagcctgacttttataaaggaaggaggattttagaaacacatgtgctgacttggctatatttttgttggtgtaagggatgagtccttctttttgaagatatttacaaatgtttccttgaggaaatatttgccacagaagtgacattttagcagctaagatatttcacactgaacaaaacatgtgagctgaaacaagtgttttacttaggggaaaggaaaacttgccgacatagatgaagctgcaaatactttctagattcaaggccagcttgaccatgtgagcagcccagcagctatttggtggaggaggggatggtgtggggagcccggagcttccccaaaaggacttttaagaacagagatttgtgcagagaagagagaagcccccagatatcaaatggcagttacaataaagtaatcatttctagctgtaacatgtttccacatccttcttttcatccaaaccttgaatggttgccagatatttttgtttccacacacataacctgcttgctccatatttaaatgagaaattgactgtcttgttcaaactggaataaattgctgaaagaaatataagtgaggctgggtgcggtggctcatgcctgtagtcacagaactttgggaggccgaggctggtggatcacttgaggtcagttcgagaccagcctgaccaacatggtgaaagcttgtctctactaaaaatacaaaaaatttgctgggcttcatggtgggtgcctgtaatctcagttactcaggaggctgaggcaggggaatcgcttgaacccgggaggcagaggttgcagtgagctgaaatcatgccactaaactccagcttgggcgacagggtgagactccatctcaacaaaaaaaaaaacaaaagaaaagaaatacaagtgcttaaatgacttcttcaggactgggaaatcatctgtcatttggactttgagttggagcattctaaagaaacttgttgtttacactgatgctgctaaactaagaataaagactgccgttgaaagagatgctttagcagtatctggatgagagattaactccacaagaagcagcggaaatcacctatttccccttgtccaacccactcaactcaaaccacccaaaactgtcagtggatttgaaatgacaggaagtgcctaattttatgaccaataacaacattgatggttaaggatgttaagataagggtaatttaactcatgtttctaactatgaacaaatcagcggcaggaatcagaaaagcaccagcaatggcaattgactcaaaatgatcaatcttggatgttccagaccacagattttcaaagcaaaaagtagttcattttatctcaagtgggcatccaccttgtcatgcagtcagagttgtacttcttcaccaaagtttaagttagaccaacatgtcagtgccaagcaagacttcccagcctcccaagatatgagagggtgtctatttctgaactcagcaataggactgtcatccattagttggtcccatgtaaatggttgctaaacagcaggccactagcaggcattctgagagctgtccgacccccctcacgtgggctcactttccctttcatgcataaagtacctcaacgggatgactgcagtgagttctgtgccagtggcaatggaagtcacgccagaaggttgttcattttgcacagcagacattgggtgattgacatactgtagaaaattaagtacatttcacgtcaagattttggcatgttgcttactttgggagttggggagggggcacctttttcactcaatgtcatctacacaaacagatgtgctatggaagaattctcccaccttcttgccagattttgacatgtggcctgatgcccatgtttggaaggaatcagtagctcttcccctatgactgaatataaggcaacatattgttggtccttgagaaatggctcatctcccttacagaggcaaagagctgggttctgatcccagagactgctctggtatttgctgcccatgtgcaaagaatgaaacaatctcctatctacaaatgatgatttctcttgtttccatggtatggcttctcaatgaaccttggcgtgcctcttgggtattttcagttctgcaattgtgattttgctttcatcctatccagcacaaaaatcaaatgacacttgtccaggttttaaagtccttccccttgacgtgccgatatttaaacactctaagactgcacactttctgtgttgtcttcagctgcttaagcctaaatcttgtgcctgtaggtggaaaatgactggatactattaccctgatagctgatgataatatttctacatccgttgctaagcttcttaagtttcttcttcactttagcagtgtttcgcatatcattttctagaaaccgtactcaatgtgccttaggtaaaaagtaagattcgatactgcgttcatgggagattatctaggactaagctgctgagcgaatgtctcagcctcactcatccagtctctccataaatgcacctttatgtatctctcaggggtaaagtgggtcacttgatgttgtttcagaacatctggaaaacagtcgctggggtggaagggctgttaaagctctttgtgctaaggctcaggggatataatgaaaacatggatgtgacacataccaaatgattctaaaacatccacttgtttgtaagtacccacactactcattatctgcttttacttcaaataagagaggtttggcaaggatgctgagttcagatatgtattattgctcctcacaagcttaaaatcccttttctggcattttggggcaatcgagaagctaagagcgactgaactgaatatccattttgcagtcctaaccaaggcaagttctagaggggcaaaagcacgcagatgaagagggtacaatgatggttgtcaggggaagcgcgtgaggagggacgcgggcgagttagtgaaagggtgcaatatttcagttatgcagagtgaataaattttggagatctaatgtacagaaagtaacttagttaataataatgtattgtatacttgcagtttgcaaggagagtagttttttgtttgtttgtttgtttgtttgtttgtttgcttttgatacaatattgctctatcgcccaggctggaatgcagaggttccactcactgcaacctccacctcccaggttcaagcgattctcctgcctcagcctgccgagtggctgggacgacagaagcacaccaccacaccgggctaatttttgtatttttagtagagacggggtttcaccatgttggccaggctggtctctaactcctgacctcaagtaatccacttgacttggcctcccaaaatgttgggattacaggcgtgaggcactgtgcctggcctgctaagagagtagatcttaaatgttttgaccacaagggagagaaaggtaatgatgtgacatgatggacatgttaactagcatgattgtggtcatcattttacaaggtatatcaaaaccccacattgcatgccttaaagttataaccttttttttttttttgagacagggtctggctctgtggcctaggctggagtgcattggctcaatctcagttcactgcaaccttagcctcccgggctcaagtgatctcccacctaaacctccccagtagctgccactacacctggctaatttttgtgtttttgtagagacagggttttgccatgttgcacaggctggtctcgaactcctgggctcaagcaatccacccgcctcagctcccagaatgctgggattacaggcatgagctgccatgtccagcctaaatatataatccttatttgtcaattacacctcaataaagctgagggtggtgaagaacaagcacaggactgagccatgaaaaacaagagcctacaagagaccagcaagtttccacacaatagatctgatgtcgtctctatttgtagctatttctggatcaactgccaaacgtgaccaatattaaaagcagccagcaaattaatagaccttaccttcctaagccactttattcaccggctttaagacttttttctaggtagagattcacagttttcaggtataaaaagtctttcctggagcatctttaattctaagccaaggaacttcttaagtgattgagtaatgtgttttgtgattctcacttcccttaaaatattaattaagaaaataaatgagagcttctccttaaggggtacactgagagttaaactgactggccttcagtgctagccatattgcactttctttcctgattagcacgggtgccaggctgttccttcaaattaagacaatatgcttatagtgatgagccgtattggccatctatcttccttttgtgatctggctctcgtcgagctgaaatgaagccatttcttctgcctggggctgattaaacacagagtaaacccagttctctaaggaggctctaatgattctctgcagagcgcgtgtcagcccggcacctgcaggcttcagcgtctctgtttctatcataaaatgaagcatctgtttcagggaggtgatatctttttatcatccagtgtatcgctctggtcggagtggatgcagctcatttggtacacaaggcttctgcgccacaggtaacaaatggtcccccaggaagttctgctctcatcaggggtaaaaagggcacagcttttggcaaaaacttttggtaaaagtcttcctggctcacatcaagtggtcttcttttagtaaaaacaggttagaaagtgtaaagggggatccttgaaataaggcaatcctttattcatcagctcatttattcattcattcaatgaatattcatcaagcaccaactaggagcgacgccccatgccaggatctggggagagagaataaatatggcagatgcagcctctgccctgttggaggtcaatgctggtgatggagacagacattaaacaattaatggtgaattaagtacttaattaccactgggaagggtatcccaaatcggaaagcaccctgggaatctataaggggggcctgatgctttggggcttcagaaaagactcccctggggaagtgacatttgagctgagatctcaaggacaagacagaacagtgcattcatacaagggtgaaagattatttttcagccaaggaaatggcatattcaaagaccctggggtggaagggtgacactgtcccacatgagaaatgagaaaaaaatcaatgaaaaggaaaatggctaaagatggggctggtgacatggacaggaatgaaatcaggcagggcttgaaggtagtcttatcccaggagcatgacaggcttgggcggtttgtgccaagagcttttctaccatttatctagtaggaaccacatagcacttgcgttgccagacactgcccagacacatttaatttatgatttgcaatcaatctaacattctttcaacaaagacattttagccactccttgtaggtgaggaaattaggacttagaggggttagagatgggccaggtccatgtagtcagcagtatgggcccaggtctctaacccagcccagcccagcccagcccagcctagcccatgtcctggctttttcctctgtgccatgctgccttcccacccatggaccaaataatgaactgctaaaagtttgtgaggtttgtgccacattgtactttttccaattgtttgactctttgggagaatttctaagttactaattgataatattaaaataataatagctctattcatatcattatagaattaaagatagtacagcagatttgccttatctcttagaaagaattcttggcaagaagggattaaactagtgtcatgtagaagctcaaggcctgagatctggaattagattgacctgggttcaaatcccaccttgtccagtaacctagagtaacctagagcaaggtggttacaaatattgagactcagtttcatccctgtaaaatggacatattcacgtctacttcagtttgttgttatgaggattgaatgaaatagctatgcaaataattttccaagttcctgagtggctcagtccacattcgcacctgtcatcaccaccaccactgccaccatcttcttcatcatcactgttagttaacagagttgccaggtcggtgggacatgggacatcaaacagctcatctctttcccctggcaggtgtttttgagcctattgcaaatgtgttgtccattttcctgctttctcattattgaaaggaatgtgaactcatccctggcaggtagctgaggactaagtctgcctaagaatgtcgtgcagacattaaattcaagaacatttgaaaatgacacaaggcaattccaaaaagacttaaataactctacaaaaggagacatagatgaacacagctggatagggggcatttaaaatgtacctgtcttttaaaataaatgactataccaaatgggaggacttcattttgctttgaaaactgcttttttgtcattagagttttatgcttttaaaaaaacttttgaggcatcaaattgatcatttttaaatagaacaaagagttcacatgcaaatattatataaatataacataggtgtgtacagatgtgatgcaagttcccctgaaaagtatataaaacatctaaattgggaaagagatctagacaaagccacctgctcccttgatggttatctggatttcaccagagtacctgccatgtccctccttaggctgcttgtatccaggtttatacaaaaagatccacaaaaatcacttaataaattaaacaatgcttataagagctccctgtccagtgcctggcaccttgtcagactttgatcaatgttagctattgcaataatacaacaatgatactttaggattgcaaaagcttttaaagtcctccactttaatgtctatgtttcacagatgataaaactatggtcccaagaggtcacgaaactttcacaatatttcagagctactaagaccggagcctacctgtaagggcatgaagaagcttaagcaatctgagatctgagataaccagaaagtttcagaatgcctagcgctctaaaaaagctattcctatctcatgggattgttctttcatcacactaattccactggcattcctttcttctcatctgtccccactaggttctgtgagggcagggattgtgtatgcctcatttcccaccttctccccagcagcagcactatcacctggcatgtggtatgcattcaatgaaacgtttgtaaattgaatggaaatgtatcagcacaaacacaatgccaaaggacatgccaaactgtcatgatgtccatcccagaatgacatgcaggacttagttaaatgttaaccttttacgactttgagagattagacagttttgttatataaagaggtgctgaacaaaaaacaaaaggtaacatgtgcccagtgagtcaagcttgttgtggctgatcccttctcaatacaacttcctggctatcagagagagaactctatctgcaatgaacaaaaccaggttaaaaaaaaagttaggtgaagcagaagctgtggatttagcagagaactctatacactatagacatgctgatgaccaccttcaggcagaagatctgtccatttggaaatctcattgccaatcccactgaaatttgttcacggttgtcttaaatgtggtttgatactcattgtggtcctaggggcaaagtgccagtggtgatggagaatcctgtgtctctataggaaggctctgtcaactgtcactagcccaacccataaattcaaacacaccatttgtcagcagcccttcttcctgccaggcttgcagggtaatgctcctttccctcaacataaagtgtccagagatgggccacaagaaatggatggggtgaaagacatgcccggaattgtaaatcactcactctctctgaaattcaaattcatcttctataaaataaggactgtaaggcttgcccaatccaccccaccagatgggtgcaaggtacataaaaggccactgacaggcatcttccagaatgtaaagttgatacaattataaactggttttcatgtcttgagagtgtcccactaggtgttacaaggttaacaaaatgaataccacatggccctgcccttcaaggagattatagtgtagaagcatggtgagttgaaaaacatagaaagatagatatagaaacacacacacacacacctgttctcttatcaaatattctcgtgaagaaatccaatatagaatatgctaaagtgcatattaaataatctttgtttgattgatattgactactctcaatttcactcgaatcagcatataaagttttacatctttagaggagaagaataaaaaacttataaatggggtcctttatatgaaatcctataaattcaaaaccagacattattaaaatggatgagaaagatgttctggagtacatgtctgcctcttatttcctgtacaggacccgtgttttctgtatgagtccacaagatcgaagactttatggacagaagtcatgtatcttcaacacaggtaaaggacttgcgctcatgaaaagttgggggtttccctcccttatcaaacaaacaagcacgcttgatattttgccaaaactgattagattatatctgcacttaactttgcggtaaatgcaaaaacaaaatctctaacatttataaacaaaagtttctttcttacttcagagttcaaggcaggaaacaactttcactgactcttagacatactacagcttgaatgttacggggacataaaatgtatttattattgctgtagctcaaaatttccatcccaccacatttgaacactgatttggggtttacaaaaatagcatcagcaacattgccaaggagatcctataaccttaacccaaagtaaatatgaaagcagaaaagaaatgcaacctttttaaagttctctctatgcaaatatcatgcagaagtcactgactactgaacactcccatgcctctccaatatctgaaccaccccggaaaaataccatgatgatctccttgttattttgatctttcacagatttcctttaattcttattcactctttgtgttggtgtctgtatctacagccatcatctataggtggtaaatttattaaaagtccaatacagtcatcaccacaaaatcacaaaagaagctttttataaaacctctgggtctatttatattctgagatcaaattgtcactctatgcctgagccatccgtcaaaaggaaacatattaatagtagtgtggcatgtgctaagacttatggggctacaaacttcctaccctgctatccccaaaacacgtatctgcgtgaatttatgtccaacactgctgagggtctggactaaaaagaactttggaacacaaggttctgggaagacatgggaagccaagatggaagagaatgctgtgtgtttcccagatggtgccagaaactcagtctgatgcgctctttcacaaaagccattatgagactcaggtccaaactgtactgcctacaggctaaagtgatgaagtgagacacacagacagagggatctgccccacacacttcaccacagacttcacagccactctgactcctccaggaacaacagtggagaactgctgggcccagtggagcccagatgaagcaaaagaagggaccagccatgacaggtggtcttgttggggccatggaaggatctcaagagctatgaatgttcatttgacttcatgtattcccataactgagacctaggaatatccaggtgccctttgtgtatggagtgttggattgaacttgcattactcacctaaaatatgtgcataaaatttgcgaagtttaaatttaaaatttgagcatcacttcaagaacacttagcactaaggtccctgaaatgctcattgatgatatgaagctgaataagaaagcctgtccctagggttcctttctctaggacagacacaccaccaacactggcatatctcttctgtgtattagcaaagaattttgttagcatatcttcatacagcttctaagagacctaagttattaacactcatttagtcccattgtgtaaacactgggagaatctggctgtcttttaaaatgcattcagtattcataaaacctaaaaagtatggcttaccttcacaaaatgattggtgtccataattgtgagtgtcaatatatgtctagaatttagcatttaccttgtgatacacaatgaagaaaatacaactaactactcttgagaaaataactcaaactctctaggtggggaatagattagtccatcaaggatacaagcgaggaacacttactaactataaaaaaaaaaaagttgcaatatcagaagccttttagtaacacggtagcctaaacagaggagaacaattcagaactcaattgtttcttctagcttctggccaaagctctgacaagaaaaataccatctaaataccaaagaaagttttattgtatatgctttttggtttttgttttgctatacaagaaattattaaaatttacacttgtaaaactagttatataaatctttcctcccacaccatccttgtccccttagcagttattaaagcaggtgtgttttccctgaattggataaaataccatcaaggtccaaaataaaagaattactagcaaactttgatgaattctagaaattgatacaagaataaaattgtatcatctccttaaacaagactattgagggctggacgcagtggctcacgcctgtaatcccagcactttgggaggccgaggcgggcagatcacgaggtcaagagatcgagaccattctggccaacatggtgaaaccccgtctctactaaaagtacaaaaattagctgggcatgggggcactcgcctgtagtcccagcccctcgggaggctgaggcaggagaatcgcttgaacccaggaggcagaggttgcagtgagccgagatggcgccactgtactccagcctggagacagagcgagactccatctcaaaaaaaagaaaaaagactattgaaaaattttacccagttaattcaaagcttcttcgtgtgggggaaaacaacaaaacaacaacaacaacaacaacaacaaaactcttagtatgaatgaatattttagcattttgaaagcaggtctttgtgagaaaattccataaacaaagaaaacttttagatgtgtcaaattcaacaatctgcttacgttggtgacatgaaacacactaagtctttcaggaggtccaactttaaaaatattttaaatgaccaatgacatgaaagtatgaatttgcttcacccttttctttttgatatcagtgatatattaaggaaaagataaagtaactcttaacaaagtaacattttatttcccatgattaggtctgttgacaaatataacaggtataaccaaagttttattaagcagttaaatttccaatcttggtaaaagatatccagaaccagtccacatttgtattttaaatgtttttgtttaactcttctgcaggaaaaaaaaaaaagtgttcctcagtcattcatatgtgatacgagattcagtgcatcttgcaaaatattatgtaaatatttgaaaaaaactgctcttttcaattgcaagaaggcaaactgtaaaacgcatattgtgtggcagcatagatttactgtttcaaattggatgatgcaggcaaaagtactttgtaagtggtaaataaagttctgcatatttgcaagttattcaaactgcttgtgaagcttcctacatgaagttgatggtggtggtgataatgaataacaatagctattatttactgagtgagtgtgccagccaccattctaagcacttaacatatatttgcttatttattactcagaagaattggtggaagtttggttgaagtagatactcttattattgccacttgacagataaacactgacagtacaaagaagttaagtaaattgccttaggtcatacagctcatcaccttatgactattaaagtagttcttcatgacttcacgcaactgtagtcacaaatgaaactgctggcacagaatttatgaattactgtctagttagaatatatgatccaggtaacccaacctatggccacatttctttttggttattaaagtaaaagcacacatgcgaacttatttagatacccaaagatatggcaggcatctttgaactaacgcacagacttgttctctttgtttgaaattgattcaaatgagtcatatgatctgtacaaatgctcttcctgttctagagtaagacatgctaaatgtttaataaatgagtgtgtgcttcccagtgtggcagtgtttgcctttcttacttggtgtgttactcagaaatctttggtttgctggctgggtgcagcagctcacacctgtaatcccagcactttgggaggccgaggcaggtggatcacctgaggtcaggagttcgagaccagcctggccaacatcatgaaaccccatctctactaaaaatacaaataataataataataataataataataataataataactgggcgtggtagtgcatgcctgcaattccagctgcctgggaggtggagacaggagaattgcttgagcccgggaggtggaggttgcagtgagccaagattgcgccactgcactccagcttgggtgataaaatgagactgtgtctcaaaaaaaaaaaaaaaaatctttggtttgccatgagtaaaaagtcaactgaaaccaactaaaaccaaaaaggagaaacatattagttccaataagtgaggagtttagagagttcagttttcaggtgtggctggatccaggtactcaagtaatgtcatcatgcgcatctaactattgctcctgctctgtgctgctctgcttccttctccattggcatccttcatcaggctttcttcactgcagttaatggtttatatgtggctcttctagaagtgagcatacttctttctttacatctccaaccaatgtctcaggcaagccttgtattggcagagcctggtatcatgtacccatctctgaacaaatcacttccttcagaagaataagacatctgactggctaatcaagaagtaggaggaggagaaagtggggggaagggaagagaacatagagaagatgatggtgataaatggacatgtgacataagagtagcctctcgtagcccagaggtgtcttgctgatttttatctttaatgttatctcaaaaatttagcttccaaaaaacaaaaagaaatagaccattccatctcctctttaggttatgttgtttatttgtgccttatttattttatttaaaagaaaatactacagagtagctttgaacaaggcaaggcttatatggatgatgccatttaggagcgagatagtttctttctctgcttcattgtacttggtgataattataatcggtgcccatggtgactctttattgtgtcattccaataaattcacattcatatttaaaatcataaattaacaagggttactacaaagtgttccttattacacatttataatttctcagacacaaggaaaataatgggagtttccctgtggtcatttgtcacataataatatccttccgccctgctgcatacaaaggtcccattgattggaagagcagctacacttgtgcgcagggccaaaggattggggaaattctcaactggtttaacaagaatgagcaccacacattctgaaaggtctgcagtgaccaagtcaccaaaactgggtctgcaatgagaattgggaaaaattagagaagtgcctttaggcaactagaaactgagagaccgagagttcacataagagcaaatgagtatcttgggccatgccttatatttctcctgaaatttcttcccactctcaacagagagagagagagccaagggagagagctattccatagccacatgggtgccggtcctcacacccagaccctgaagcccccgtagcattactgagaattatattctcccccttcccttgacttttttgttgaacttttctttttcttttagacccaggacagaacattgagtaagtcatactcctcaactcatagcacgctatcgttacaagtttgtgccaagcccttcactcatgtgttcattaacttttatctccttttccccttccattttcctcccacaacccataaacaatagcagtattgtgttcgatgacatccttgagtttgtatgcattctcataagacaccccaaatttccttgctctgtctgtatatgtaccttatatacacatacgtttatgtataagcatatatatacatacatgtttacatatatacacatatgtatgtttatacataaatggtgcccacagatgtttttgtggttttcctccctcttagtcagtttttaagatttaatctgcactgcttcatactgctgcatagcattgtatgatgagcctccctgacatctcactacccatctccccagcgaaaaacacctcagtcaccccatcctcaccaccacacccaatgctgggatgggttccactcccaggagcaggacagctgggtcatggggctcatggatcagtctccatctgacttccctgcgttgactatgaagcacccaccatgatgatggtatcaggttcatagcatgtgaatggaagaatctggggctcaaagaggttaagtgatctgcctaacttcacatcgctagttaaatgctggcgtctggatttaaagccaagtttctctgactcccaggttcacatccttccaccgtagactgccctctgagacagccacgtataaaggggtcctggagaacctctgactggcctgcacactgggaggagtgtggagtctcgggaagctcatgccatttgcaggagggaggagcctggctccttctcttcctgggtggtacctgggattcagcctgtgaggtgggaagcctgtactagcaggactctcactatgctgagaatctgcttccccttttattcccttttgcccaataaattccgtttttctaacccttcaaagtgtctgcaagcctaatatttcgtggttgtgtgacaagacccctatttcagctgaactaaggagaaaggcctacaacacttccatagagagcttatgtttcaatatcctaggctataggtagcaaagatttggttagcaatctttcttgtaagaaggccagaaaaagtattccttcccttcatcaggcatccaatccccccagtgccttcaggcctgctgggagtggagaacagggcctgccacaaggtcattgtataatcagaggtgagggagagccccactggctaggggccaggcaaacgtaggcctcctcgcacccctgatgcaagcagattaacagctgccatctggcaagcacagtttctccatgcaaactgcaaacctcaccccccgggtgaatcactggtgtgtccaataccagtcaagcccgatgaaactctgatggctctattaatgaagatgaaaacttgagatacgccaaatacagattaaatggcatcttggtaacatgattatctctgaattactagcagcagagagacagccaaatgactaatcttggggaaggccgagtgctttggacagaggattcgctacttcagccccagggcatcatttgctgtatcagagtcgtattttaccacagggaacacccaagagtggtggcttcctctgcagtagaaagtcactctgtttccagagaagatttactttcttcaagttctgagataccaaatgcagaatggtctgaaacaagatgacgagggagtatgtcaggaaaaaatgaggaggaatcacaggaatctggcagatgttcctgtcgatagcattgttgaaattaacagaaatgaaaggatagaaatgattgagaaggaagcctaaaagccacaagccaagtcattttctcctgctttctttccacttccgtctttagctctctagtatttagtaagctcttcattctttttttttgtttttttttgatggagtcttgctctgtcgtccaaactggagtgcagtggcacagtcttggctcactgcaacctctccctcctgggttcaagcaattctcctgcctcagcctcttgagtagctgggactacaaacacctaccaccacacccagctactttttgtatttttcttttttcccgagacggagtcttgctctgtcacccaggctggagtgcagtggtgtgatctcggctcactgcaacctccgcctccagggttcaagcggttctcctgcctcagcctccccagtagctgggattgtgccactgtgcccagctaatttttgtatttttagtagagacggagtttcaccgtattggccaggctggtcttgaactcccaaccacaaatgatcctcctgcctcagcctcccaaagtgctgggattataggcatgaaccgccgtgcccagcctgtttagtaagtttttctatgctagtgctttcaatccattagcacatgtcacctctgtgaggtgggcattgtcatttccatgttccatgtgggaaagctaaggtttacagtgttcatgaccagacacagtggctcactcctataatcccagcactttgggaggctgaggtggggggatcacttgagcctaggagactagcctgggcaacaattgtgagaccctgtctctacaaaaaaattaaaaattagccgggacacctgtgctcccagctacttgggaggctgaggtgggaggatcatttgtgcccaggtgggtagggctgcagggtgctatgatctcaccgctgcactccaggctgagagacagagtgagaccttgtctggaaaaaaaaaaaaaaaaagagtgttaatgacttgtctgacatcgcacatcagctggaaaagggaggttaagaaattttcatcttcttttttttttttttgatatggaaatccagctctgtcatccagccgggagtgtagtggcatgatctcggctcaccgcaacctctcccccctgggttcaagcaattctctgcctcagcctcctgagtagctgagattacaggtgcccgccaccatgcccagctaatttttatatttttagtagagatggggttttaccatcttggccaggctggtcttgaactcctgacctcgtgatccatccacctaggcctcccaaagtgctgggattacaggtgtgagccaccgtgcccagcccattttctttaaaacagatgatccggacttgtcaagtgatgatgatactagaggagtgggattgatagtaaatatctgtagataatttgggatgggtacagtggctcatacctgtaatcccagcactttgggaggccaaggcagaaggatgcttgagtccagaagttcaagacaagcctgggcaacatactgacattccgtctctacaaaagataatttttttaattagtcaagtgtggtggcatgcacctgtagtcccagctactcaggaggttgaggtgtgaggagctctcgagcctgggagtataagactgcagtgagctactatcacatagttgcacgccagcctgggtgacagggtgaaaccctatccaaataataataataataatttgacaaataaagtctcttttaatgtagctggaattgtgtaagaaagtctttcctcagcaaataagaaatggactatgaaatctcccagaatcttttttagcccctaattagctataaatctcctgacagtttagccatgggaggcccaagacatgaattggtggcatggcacatggtctaatgtgcatattgtataaagttatctaaatacatcttgagagagtccacgctttctccattcttttgaagtacatttccatgggtagcagacagatgaacaaaatgctggttctaggacctcagatatactgtacctgtttcaatcagatgcataactgtggtagggctgttattgtttacttttcatactatcactagcaactttaatttttggttaagttctcgaaatctctttctggaaaagcaaatgatatcacattctccattctcctggttaacagtgtcattatcacactgcagattctcaaacaaacagctaagttccactgtcattccgaatcctttctctttcttttgtaatgcattcacaaacatattcagtcttctgccttctcaatggagaaaatgttatagaaactactataagcggtgcataattgtaaatggctttaaaaagccatatggaaggatgaataatcttcctttttgtttccatctttccttaatattcttttgctttgtgttttgcaataccttttgcacccagctttggtcaaaattgttgttggccatttgccagtttgaaatgtcctacaaaatgaattgcttcttttgtaaataagaaaaatcttggtaactttggaaaatattgcttggaaataccacactggagttatagctagctgtgagcactttctgtgggggcaaaggagtgcagtgagtttattgtctgttcagcatgtataaatcatgatccaggtagtattttgtgcttgccttcatatcttctagcagctgtaggttggggcatcgcaaatattctttcaagaaaacaccacgtatttcctttctcaggatggcctttcattttgggttaaattttcaaataacacaagtaccagatggaatttgggacaaatttttaaccactgatttattggctgaggcttaatgaggacaccatgatattcaaatgaataagttcacccacttttattggcttccttttcttaatttttacattaagaagttaatttagtcctcttacaagttaaatgccaacctcttctaaaattattctaacaaggtaacttctgatttggccactttttatcttttctctttctcctatcatcctgtgcttttcagggtgaaatatctgtaaatgacacatcaaggacagataacagagttgccagttcattctcaaaccaaagcagtcatcaaaattaacccaataatgcactgcagggcacttagggtatattatcatatggaaaataatgtctgtaatttttagggacttagaaaagacaatggaagcacaccaaaggggaatttattaaagctcacattttttttttttttttgaaatggagtttcactcttgttgcccaggctggagtgcaatggtactatctcagctcaccgcaacctctgcttcccgggttcaagtgattctcctgcctcagcctcccgagtagctgggattacaggcatgcgccaccacacccggctaattttgcatttttagtagagacagggtttctccatgttggtcaggctggtctcaaactcccaacctcaggtgatccgcccgcctcggcctcccaatgtgttgggattacaggcgtgagccacggtgtccagcctaaagttcacattttaaaagagaaatagttctctatttttgcccatcgaaagaaattctatacatatatacactatgaatcactatgtaggattattaaagcaactttcaatagttttcttcccaatatatgattcttcttgaatcatatatcttaatacaatattcaaaattatgagaataaaattttgaaactttattgaaatgatggactacttaaggtaggattagattaagggtcacttaaaactgtatctctgcactttcattcatgatgtagattattttttattttgtcctctgagaattagctgaaataagatgtactagaccaagatacctggacaggaaattgccacgaggtatgaacaaaagacatccaagctctccattctaatgaaaacacaatcagccatatcttcacttagaagaaaagacaaaacatgcaaacaactcagatattttgaaaattgtcattaaaactcagcttatgcataactcatagtgaggggcatctaactaatcaatgaatgagtggtacaaagcatcaaaccttgataattttcagtccctctcccacagacttttaataccatcttaagaaaaaatccatttaaatgtttacctaaattcagaaaaaaaatcttacgtagatataacatcttgaatctccttagacacattgaagagactactaataaaagctactcagaatcactacatgaaataatgcaggtgctctatgacacactgggtcacgtcatagccacatactaaacaaaaatacagttagtagagtccgttggatacaagacatggtacttcttcatttttccacatggtatctcaaacggtgttccctctgaaagccaagttttatcttgggaaagacttcattttaaagaccaaagcccaacattacagaatcttagaattcaacaaaaatacagagaacatagttttagcgcaaattttaattgagaccaacctttgctgatgtcactacaagcaaatacactaccttaaaaaatattaaaatacacaactctcagactttatttctgtgtgtgtgtgtgtgtgtgcatgtgtgtgtgtatattaatgcaagtcttttctacaaagaaacttggccatagaactccttctcctttgggagtgttgtatttttgttttcatatgtggcactgtatgtatttctatagttgtgaacaactacatttgattaaaatctgtcagatttatctttttagcaggagaaaagaaatatgtgtttctccagaaaggaaatcaatgtgtcttcatgatagatgcggagtggaaagctggagactgtcgcttcaagtgatgaagcagaaagacagggtagctatcacaattggctgccgacataattgtcgtgagccaaagccctgtttaaatatcataatccttgtttatagggtagacttagattcattgacttagtagttattactccgacttgttaagtaacaaaatcttgcatctgaggtatccgtagtttgctctgtttaaatttctttagcaacatactttagccagagctgtgctctgttcttttctgtagtacaagaaagattatttccttccttctaggaaggcaccaggctttcaaggccctgtaaatgtaccaaagaatctcccttctcaaggcaaacaggagaaacccaggctatgccagagacagatgtagcaggaaacatactcaaggaaggatgggaggctgcttcatgacaaaaatatgtccaaaggtcttctcccttctgttggaaatcactctcctccctaagatccccaaggtcttcagatagagctatgccagatggaaaagaaagcctctgcccttgcattgtgagattaagagattccccattcagagatggtacaaccagcagacaccctattaagatagcctaggaaaattaggtgagctctgatgtctttgcagcagacgtatgtatgcctctatgattacagccagcaaaaccattctaatgaacttgtaaagcaacgtgaacatctatgaactcgcacatcagttgaaattgctatatcttgtgtcttatgaacgaaatctgtcagcaaagtatttaacgtgtttatctgcaaccaattgcaataatcacattcgatgcataagccccttttttacctaacttcttctaaaatgatatgttgatttctggtcctcaatgaatgtttctggaaggcattctattaaaatgagtgtgtgctcagcatattaacccagacctgattaaatcgttaaatgaaaggacactgtatgcaaagcaccctagtcaagggtttggaacatgataggcacttatcacaggcccatggcttagtcatcactcttctcttcaacttgcatcctaaaaattaaatcaataagcacaaataactaatgcatttgcctaaagctaaataactcttttccactaatgtccactctctacccttaccccactcctgcaatcaacaagttattcagaaatcaggatttaaggattcattgaccaccatcacatccattacaactaattggaagcctttatataatttgctaaagaattgtaataactgagacacattgttgagttctggtaatagactctatctattgtcatagatagacaatagatagagtctattgtcatagatagtggtgtcataactttttgatacactgatggaatttaatttgctaaaatctcttcataattctttattgaaattggtcttcaaattctgtactgtctttccaagttatcttcacaaaacaatttgaatgtcattccttgttgtggtcaaataaagtttatataatactgcaaatgatttttttaaaagactataatgtcatctgtaaaaccatctgggtctggtgccttttttaatgcaaggtatttcactttccagactcttctactactaattgatttatttgtatttcctatctcttcatgctataactgatttccagagtctatatttttacttaaaaaaaatccctttactctaggcttccaaatttattcctgtggagttgtacataatatccaccagtaaattttcttatcttcttcatatctgtggttgtagttcctttataatagtatattcatttcattttctccctctttctctctccctctctctcttcagtcataatagacagaattgtatccagttcatcaatatttttaaagcgcctaattttgattttacttatccgtttttatgtttgtcttctattttgttagttttagcttttatctttattaattccctccttcctcattcatattttattgttactttagaatttaagttcagtattttaaaatttattttcaatctttttttaacaaaaaacacaatttaagggtataatttttgcctcagtacaaagttgtttgaatgtcctatatagtaggaaatacttttattactctaattcataactttaatttggttatcttctttgatccaaggattatttaaaagagtgtttttaattttaagaactttttgtcaactttttatgctcatgtctagttttactgcattatgatcagaaatgtagcctataaaacctctactttttaaatttcatttagtttttttgtgtggtcagttacctattaacttttacaaatgctttatggacacagataaagataaaaattcctgtagagtaccttgatacacacacacacacacacacacacacacacacacacacatttgcatagatctgtgtgtgtgtgtttgtgtgttccatgttattgactatcttattgaaatccactatatctttgtttactgtttggtttttttttttttttgagagggggtcttactctgtcacccaggctggaatgcagtggcatgatctcggctcactgcaacctccacgcctcccgagttcaagcaattctcctgcctcagcctccctagtagctgggactacgggtgcctgcaaccacacccggctaatttttgtatttttagtagagatggagtttcaccatattggccaggctggtctcaaactcctgacccattgatcctcctgccttgggctcccaaagtgctgggattacaggtatgagccaccacacctggcctgttgttttcttaatctaccagatactgaaaatgctttattaaatataccccctacaattgtattctttttttttttttttttgagacagagtctcactctgttgtccaggctggagtgcagttttaccttatgtgtttgtctcctgtgttatttgatattttgtgttcatcatatttccttaataggttatgccttttatcattacatagtatatttctttgaagtgtttcatgaatccaaactttcataccttggggtttgttgttttgttattctttgcagttgtcgatgtctttgcccaacccttaatttacagtatttcactttgtcataggtataactcttgtatggggcattaagctgggttttgttttttaacctagtctgacatttgaaaaggaattatatccacttacatttcttgtaataactgatctacttaattcctccatcttatatttaatttcaatttttttacattttgctattgtttcttttttacctgtttttatatttttttgctgacctcgttaagtttctcttctttttttttattcctcctggtaatttgcaaggtatttttgtttgtcaaatgtgctaaacatcaccttccttccataactactgaagttaatgttgactcccctattagcatatcattattaaataattatttcctcccactgtgatattaatttccctatcccctaccatcacacacagccacacctcttaaatccagagtttttcccaacatctcattctttctgttccaataatccatactcaccaatattttacaacatctcaattacatcattatcatgatccattgtttccgatcctttcggtcttgagatctccattgttttcagttgtcattcgggtagataattttctgcagtgttttaatcagaaaggctataggggtaataaacagagtccttacctgtttccaaaataactttctttggaaccaaataaacaatattttcttaattatacgcttctttgatttcagaccttttctcacaatagattttatttcaccatctctagctttcagttggcttttctctatacacttaatttttatcatctttcagctttccatatggcagacaagcataacactagtccaattctcctttaatttttttggcttttttttttttcttttgtggagaacggggactcattatgttgtccaggcaggtctcagactcctgggctcaagctatcttcccagctcttcctccctaagtgctgggattacaggcatgagctgccacacccagctctcctttattttcaactaatcagattgctctattagaaaatgtcattagtttaggggtttttttaagggagaattttgtttcgtttctgtttttggatttttgtttcgttttgttttgctttgtttagtataaagtgtcataggtcaggttccctgggaaacattctgagatggggatttgtgggcaggaggaattttacagaggagtgctcttgagaacaatgactataaggaataaagaggcaggattgggcaaagggaataactgagtagctgcgcgcagccttaacagaggcctcagctgatcttatgggagctgagtttgagttttcatattgggacaagagaaccattcctttgtacgttgcatcaaccagtattggatatggacagcagtgggtggggagttagggcgccccagtcctgaagggggtatctgggtgaaactccacagtgtctagtacactgaatagtcatgaatttaatgaggatatgttgagttacatgtttttgtttggatttgttttgttttgtcttaattcttacttagactcagctcttgtaatcaggaaactaacttcttccttcagctcagtgaaatgttccttcattttggatatagtaaccacttttccaccctttcctttttttcttctggatggcttattatttgcatgttccatttcctggatctgtgctttaagtcacctacgttttcactcatgtgtttccatctttgcggcatgttgtatttccttttacttaatcctgcagctctctaattcagttgctatcaagaattatgccatttttccctcattcatctaatagctatttcagtgcagacatcatgaacgtaggtccagaagatctttgtggtgtttcaatgacacatctttgagaatgctcattattttcatcttcatctctccgtctcttctatcagcaaatgagtcgtctgtcctaaccatctgggtttctctcctctagttcctgaatcccactggagaagccatagtttttcttgaaggtcatgttctattagtttgtagaggtcagatgtttggttctgggcaaggagaaagtccaaaatggtagggaagtttatcttcctgttaccatctgctgaggcactgaaaggactggcaggacacccaacctaccagatgcagaagctcatctgctagtttctgcctcactcctccagggctaccatgattagcagaagtagagggtccttccatggaccacatcctgatgaagatatgtgaagggcttccttcaggaggcacacaatctgctctctttgcccagaccttgaaaagaggctggctttctctttctttgctccttcacctctaactcaaccctcagatgtctcagcatccccattagcgtcaggttcactatcccactggtggccttggtacctcatggcttgaaggggctgaaaagggaaaaagtgttaggggtagacactcaggcacgatccccaaagaatccccctgaccatgtttttcttaggttcttcttctgatgtgagctggtctcattttccttttcaaatgctaagtttcttgatagcaggatcacatcccctccgccactgcatttctctctgcagctaccacaagtgccaggccattgtagacactcaataaacaggggctggccttgacaacaaatcctgtgatcctatttggtgcatttcataacctttctggctaaaaggcacagtccaactggctggaataccatctgtgaaacatgccagagtatctaactcagggaggcccatgcatgtctacccacttatcttccaagaatcaggtgatgctggaaaactgaatgcttagtggagttggcgccagtaccttgggggataaggagaggaagtgtggcattggatttagcaagagattggagctccaattccagtctttccacttaccagtcaaatgatttatcttctttgaacttcaatttattcacatataaagtaggttaagaaaatagtcacttcttcacaaggctgttacagggattaaaggagatcatgaattaacatgcctgctacacaacaagagctcagtcactgtgagcttccagcattcttgttatgaccattattgttacagtggggagagggagataggcaggtcaatagttgaggggcagaaaccagggaagaggaagaggaacggagaaaagaatgagaaagggaggaccttaactctgagtcttcacccagagatcttgaaaacattggttatttaaggagattttaattccttttccagtaatagtgacatttctacagactgggtctgtattttgtttccattttcctaaatgatgtcacatcaaacctcctaagagagtgcctttcccacgcagtcacctcaaataaagacagagggatggagtggatgggaagaggtgagatggggcagaagtaatgcagcccccagctcgccagcaggtgcccattgttggaattcttcggctgtaatggtcattcccatttctcccatggagaaagacagcacctcctttgacattctttgtgggtaaggtgaaatcagggcaggaggagccacagcccatcactttctgagttgaccagagatctctcaggggcagcctgggctcctgtaccagatggcccaggttctaattctacttcttccattgagtagttgcgtgacctcaggcaaggtacttaacctctgtgtgtctcagtaaaagggtgctttattaacaaacttttatattgcactatttaaaggactttacaaatacaaattcatttagtccttatagccatagaaggtaggtcagggccaggtgctgtggcttgtaatcccagcactttgggaggccaaggcgggtggatcacttggggtcaagagttcaacaccagcctggccaacatggttgaaaccctgtctctacgaaaaaaatacaaaaattagccaggcatggtagtgtgtaattacatggtagcctgtaatttcagctactcgggaggctgaggcacaagaatcacttgaacccaggaggcggatgttgcagtgagccaagatcatgccactgcactcccacctgggcaacagagtgaggccctacctcaaaaaaaagaaggtaggccagacaaaatgtggtaaagattaaatggttcatatatgcaacgtgcttagaggcccctgtttggtacatgggaaatgtaagcgcgatccagtgttgtcatcattattgtaaatgctatccattagctgccatcatcttcttctccttcatcttccagggattctgttgcggtatagcacttgagggcattttctccctcctcattccaccaccaaactctcctcattttttggaggggggcatatctaagtttatttatttatgctatttttttttttagcaatttcaacttttagatttaggggctacatatgcaggttagttaaatgggtatactgtgtgatgctgatgtttggggtatagatgatcccatcacccaggtagtgagcataggattcaataggtagttttttttagcccatgctccctttcctccctcctgctctagcagtctacagtgttcattgtttatgtccatgcatactcaatatttggctcccacttacatgtgagaatgtgtgccatttggttttctgtttctgtgttagtttgtttaggataatggcctccagctgcaaacaggttgctgcaaaggacatgattttgttctttttatggctgcatagtattccatgacgtatatgtaccacattatccaatccacagttgatgggcacctaggttgattccatgtctttgctattgtgaatagctctgcaaggaacatagaagtatatatatatctcttggatagaacaacttattttcctttgggtatatgcccagtaatgggattgctgagtggaatgctagttccatttttaagttctctgagaaatctccaaactgctttccacagtggctgaaattgtacattcccaccagcattgcagaagcattccctcttctccacagcctcaccagcatgttattttttgacttttaataatagccattctgaccggtgtgagatggtatctcactgtggtttttaatttacatttttctgatgcttagagatgttgagcattttttcatgttttttggttgcttgtatgtcctcttttgagaagagtctgttcctgtcctttgtccattttttaatgggttgtttgttctttgcatgttgaattgtttatgttccttatagattctggatgttagacctttataggatgcatagtttgtgaatatttcctcccactctgcaggctgtctgtttactctgttgatggagtcttttgttgtgcagaagctctttagtttagttagatcctgcttattcatttttgcttttgttgcaattgcctttgtggacttagcgaagaatactttacaaggatgatgtctagtaaatatttcctaggttttcttctagaatttttacagtttgaggtcttacatttaaatctttaatccatcttaagttaatttttgtatgtggtgaaagacaggggtacagtttcattcttctgcatatgcccagccagcgatcccagcaccatttattgaacactctccctgtttttgagacacagtcattttagtacttccatcacattcttgcctccccttgacactgcttacctttaccatctttgtgttctgaatccctgcttcttccagctaatttaaatgggttccaactctccccaggcccacagtgtgccaagcacagtgctagatattctcacctacacatattctagggcttggggaagctgggtgcaaacatccatccatctccaaaacccagtcccatcctattttatcaaattattttaaaatattccactcaccttcccaactttgttattcatcactcttaaacactgaactgatttgcttacaaggcagatcatctaaatgtttaaaataaagattcatgctaacttaatgtagctatgtatgattctcagttgtctgtatcttttaattttttaaaaaagatagtatgtgagctgctatgtatcatgtaatgtgccttcttgaccagtggtaggttcttattcaagcaaataaccttagataggactagtgacatgaatgtatttgctatgttaagaggaaaagctggttacaaaacatatgtagaatagcatgctattttatacatctgcaaagatatataccaatgccatcacattggctaacttgtagaaaaggaaaaaattatttttcagggtattcttcttagttttgctttttgtatattctaatttttctttgttttgagtatgtactgcttttataatgtcacaaagaagtacaagaaaccatattttgatgggaaacatggttggaacttagccagctgaaaccatcctcaataaagcccttcgttttttgttttgttttattttatttttttaagataaagtctcactttgttgcccaggctggagtgcagtggcatgatcactgcagcctcgaactcctgggctcaagcaatcctcttgcttcagcctcccgagtagctgggactacaggtgtgtgcgaccatgccaggctaatttttgtgggggcgagtagagatggagtcttgctatgttgtccaggttggtcttgaactccacaagcaatcctcccatcttggcctcccaaggggcttggattacaggcatgtgcccccacacctggccctattaagcctttaatctgctgtctcatcaggctgtgcacttgtctgaaagatggctctgtttattgtgtcctaccatgttgttaattactttgaactcaaaacatctgggtggcaatgtctatagctatttaagattcttgttttcatgttttgaatacacagaaaggtatataaaactttttctgatgataatgatgaaatcaagtcctatgtgttgaaggcaaaattgacttccctagcttggtgcatgaagaaaaacaaaggtggagctaagtcctcccactctgccccaccaacagcatcttaggatgcagggcacactgaaggcccttggccatgtcacaagcaatctcagatggagggtacttactctctcagcccattttcttccttgtataactgtgcagtttcttaaactaccctttgcctaactacatattttaatcacattcattaattttcaaagtgcctatttttcttatcattctagaagtacacttcatatactgaaagctaatgagcatgtgttcaggaaatagtgaggagttgaatttagattttttattaaatttgtatttttttctatttacatttttctgattaaaaatgtggcttgtattttgtttacttctacaggaaacaaagagggtggttatgtctactcaaaaccaagcatgtatctgaaaaagtagaatttcaattacatatccagatattacatctttttgctttttattttgttttgttttttgagacagagtgtcactctgtcacctaggctggagtgcagtggcaccatcttggctcactgcaaccttggcctaccgtgtttaagtgattctcctgcctcagcctctcaagtagctgggattacaggcgcaggccaccatacccggctaatttttgtatttttagtagagacaacatttcaccatgttggccaggttggtctcgaacttgtggcctcaagtgatccacctgcatcggcctcccaaagtgttgggattatgggtctgagctaccacgtccagccccgctattatatctatttaataccaatacatgaagagctgggttggtgtttgtttgctttgctttttgtttggttgattgacattatatagaatgccacagtggaaccgaaaacctcctctctacttcaaaaattagaataaaatgaatttaaattttttcttatacttttctcaggtgcctttgaaaaatattaagggcactaggttaaagctattaaaaggcatatgtttgtaagtaagaattgtaagaactgacagaaccgaatattaagaattactttaaaagctaaaaactttaaagaaatattagcctggaaaagtggagaataagggtgatttaacaattagttccaaataaataacagattggtagagggtagacatcttgttgccatcccacttaaagacaaggactcttgagaattgcctttagattctatcatgcctttgatcacacataacacagtgctggacacgtagtgaatgtccttcaacacctcctattcagcatacttcccatatgtatgcaggcactgtgtgactgaccacctggggcaggtaaacagagctgcaccatgctgccacagagctggacccaaagtgttctgagaagtgtccacataacccaggcaagcatcaaggaagagaagctgtgcagaaagagcaacatctctaggagtagcttttacaagtgaagagagattgtgcaagtgaataaaagaaagtcagcgattccaggcaaggggaattgcatggtcaaaggcactaaggtataatgtgcctggcaaatagacttctgcaggactagagagctggatttgtggagagatggcatagtagaagcaggcccaggccacattagcaaaagtttttcttgtacaccatgttaaaagtctgggttttgtctccaagacaattgtagaactcttacagtaaggactctctacagagaaatgacataatcttattaacataataatgtttaaaatatcactatagcagcagtatggagaatagaatggtaaggaattaatactggacgctgttgcaagattctaggcaaaaaaatttttaggaactgaattaagactgtggctgtacaggtagggataaagagaaggaagcagagtcaggcgatgataaacagcgctggcagaacttgtgaatcgccttgatggagaggaaagaggaagagaatcgtccaagatgaccctagggtcttgcattgagtgactgggtagatggtggcttattttccccaaacaggcaatacaggaggagatacagatctgggggggtctaccaagggagataatccatttactttcctagttgtagaacttaagagtacctctaaggaggaagtcacatttactagcatataagaaccatgagaatggggaccttgttggtttcattcactatgtcctcagtgcctagcacagcacacagcagatgataaatcctggtaaattctagtcgaatgtgtgttcctcgacacagttttgggtccaggtctcagctattattcaatgctctttggttttcttccatagaaaatcctagaacctcctttgatgttgaccgaggttgtcttgcctccagaaataagagattctgctccatgctggcgggggtgagttacaaaaccatgactaagattcttaatggtcctatcactcttcgttaacacatataagcagggctggttaattgttaaccgacaaaaaagcaaaaactgcaataataaagtttgaagtggtcagacagagaagaattagtcactggagtgagcctctaatattgtaataagacatgtggctttcaagttgccattgaaatgattaggaggcagggcgtggtggtgcatgcctgtaattccagcaccttgggaggctgaggtgggagggttgcttgagcacaagggtttgtgatcagcctgggcaacatggcaagactctgtctctacaaaaaactaaaaaattagctatgcatggtggctcacgcctgtagtcccagctacttgggaggctgaggtaggaggttcacttgagcctgagagattgaggctgcacttagcgtgattgtgccactgcactccattgtgggtttcagagtgagaccctggtctcaaaaaaaaaaaaaaaatattaggggaaccaagtataattgttaagaatgaacatgagccaatttaatttggttttagagtaccaaaaactctaaaagggattgttgcattagaacaagaaacagtgagaagtacgtagatcaaataaaaacctggaaaaaactttaagaaaaaaagaaagaaaatctaataaatggcactgctacttggagaagttggagcaaatcttccttgccagggaagcttgaattacctgcatatctctttaagcattttcacgtacaaatcaaacacagatggcccattacgtttatgacctcactgtcgattcctctagatggagcatgcattaattattgaaatattttcatagtatacaagtttttagtgggctacattgccacagataatttcaactttctgattagaagctggtataaacaattttatttatgagaattaatctcttaaatgtagtaaacactacgaatacagtagtgattttttttttcccatttaacaaagccaaactaggaatcctggcctctatccttgaaactcagcgttatgttagcattgcatacaatacataaactctgccaaaatctattacaattgtagtaaattttgattaccggagttgtttgttatttatgtctacaagataaagataatgttgggaatagccctcttctattcaatgtataaattacttccataaaatatcttgttttgtaaacagtaaaaaaagaaaaaaagactaaacttggttgaagcttcaaattgttgcatctactttagttcaagtcaataaacactttagatgatgtggaagtccatggaagggtttagacttttaatggtgccctggtttatctctggcatgataaacaaaatgctggggccattcactgttaaagaacaataaaaacattccagtgaaggagtgctcggagagaaggcatgtggagaaacattttgcaggaccttaaggaagacacgtattttctatcattctggaagaaagctattcattcaacaaacatcaactgagcacctattctgtgctggggacttttctaagcatttgtagtgctttgggagggaaaactaaactctctttctgccaggtatagattctagcagaattgattaccttcttaaatcctctttgcaaagagaaggaagctgaagcttagcaaagtgaactaagtaaccagagattacccacacagaaggcagtgaagctgaataagagcccgggccatgtggctccagagcccctattcttcacctaccgtatctcagttgccttcaccattttcaacctttttctggctcaaaggtctattaatctgggtcattgtgaatttatatttaaaagtaggcagctggacttccttcagtctaggtcttcatttaggtcagttaacttttgaaaaatagttatctgtatttcttctttctgaaattcaccataggaaagaatgttcaggcaaagaatggcacaaataagacaggcatcgcagaaatgctgatttcacagtccagtgggatatggtggcccaagaagcagcaagcaaggtcaacatgcaattattggtttctttctctggccaaagacaaacaggtatagaaaattatacttctagcaacacacagatagcagcgctgatggcactgtgatttcacaatgggttgcacaacacaaaagagagaaattcctgcatacctcggggacaactaaggctggaataatacgatccttaaccagaatcgtgcaagaagatggaaatttagcatatgtattaggcgagaatcttctaccagtgagtaatgcttacatataagactcctctagcaaacatttataagacacactgcactgctaatggagagaattcatgtagaaattaacgatatattaattaattcaatgctgttcaattaattttggatattcatttcattaaattaaaaagtaatgcattttcctactgctcacaataaaactctctcaagtttgtttagcactttatacatttaaaaactctgttgctactggtggaagagggaagatcagagacatctgacaacttgtctgagatcatgtcaaatttggcagggaagagcctagaacccagagttactgatttacaaggtcagtccttggagattctttcacattattcttatctgatccccaataaagcaggtattatcgtgttcactgatcataggagagcctgaggcttagggatgtagaacaagtcaatgctcaattcctttccaaaaaaaatgtaactgtgcatacaaattctattaagcgtgtgttggtaagagggcatggttattgcgagccaaggtgtgcaaggacagaacataaaatatgcaataatgtacacggtaaagaagttctaccatggtagaagtaattaattttatctagaataaaaaaaaaggtccaaccaattataaatacaactgactgtaaaaactataatgatattggttgggcgcggtggctcatacctgtaatcccagcactttgggaggccaaggcaagcagatcacttgatgtcaggagttcgagaccagcctggtcatggtgaaaccctgactcgacttaaaaaatgcaaaaattaggcaggtgtggtggtgggtgcctgtagttccagctactcaggaggctgaggcaggagaatcgcttgaatgtgggagtcagaggttataatgagtgagctgacatcacaccactgcactccagcacgggtgacagagcgagactctgtattaaaaaaaataataaaaaagaactataatgatattgtgcattgtgactggttatgtagtgtctgatgctatggttccttatgagatcatgcaatacaattaccttggacacctggaaaaaagcagagtcttgtacctatggaatcagacactttggacatagagggcataaatctggtttttagcaagctgtattaggggcccatggtctaaaatcttgctattcaaagtacagcccatgagcctgcagcatcagtgtcacctgggagtctcttaaggatgcagaaactaaaacccaaccccagatctactgactcagaatctgcatttggttaaataacaagatcccctggtgatttcctcttgactttacagtttgaagagactacagtttgctggcttatggcatcccttcctaccacacattcaccttatcagaaaaaaaaaaaaataagtcagcatgacttgagctgtttttagtgaatccatgagggatctaagcgaactgtttctatttccaacttccttctcagtctaatgttctagatttccatcatcgtctgataaaggtttaccaaatatccaattaaaaatgtatcctaaattctgttgaagctcaacaactaattcatgggccatcaagtgtttcatttccaaaattcaccttcagaatatttttttaaagtaaaaacctcatttgcatgtctctaaatttccactaattcttccattttttacaattcctcaaagactagtaaggtgcattggcaatcccattggctagttttcttcgtcctctcataagataatcaatctataaaaaatcaggatatctgggtgtgtttttagtagcaggaatagctatgatgagttctacccttatactgaggcttcaggtttctcttataagtgtttgtttaaggctgggcgcggtggttcacgcctgtaatcccagcactttgggaggccaaggtgggtggatcaactgaggtcagacgttcaagaccagtctgaccaacatggagaaaccccgtctttactaaaaatacaaaattagccgggcatggtggcgcatgcctgtaatcccagctgcttgggaaggctgaggcaggagaatcgcttgaacctgggaggtggaggttgtggtgagccgagatcgcgccatcgtacttcagcctgggcaacaagagcaaaacttcgtctcaaaaaaaaaaaaaaaaaaaaagtgtttgtttaaaccagtctcttcaagtgaaatcagggtggtttttaagtttgcccatctcaagttccttgtttgcaacagcaatgtgtgctcttccctagttttgggggaacccctccagctgcctttctgaggctaggaaaagacagaatcctctttctctgatccagctctcaccactcagctaggagtaatacagctactgtaatgcttgaaattcaatgtccactcaatataacattaactttgtttgtttgtttgtttgtttgttttttgagatggagtctcactttgtcacccaaactggagtgcagtggcacaatctcggttgactgcaacctctgctttctgggttcaagcaattctcctgcctcagcctctggagtagctgggactacaggcacgtgccatcacacccagctaatttttgtagttttagtagagatgaggttttgccatgttagccaggctggtcttgaacccctgacctcaagtgatccacctccctcagcctcccaaagttctgggattacaggcatgagccaatgcaccttgcccacattttaaaatttttttaaagaaataaaataacttctcaatctatcaccctgacaagttcacagtccatataaagttaagtttaaatatgggtttgccttttacctgtccttacgattaccctaaaacctttttaaatattaatacgactttataacattttaaagcccatataatatttcaacattgatatgttatatgtatggactcaatctactattcttggacatatagttggcttccaatttttcattataacacataaattctagaagctaattttagagattcaatcccaatatttgacagttatccttaaagaaaaaaagaaaaagctcgtgcaagaccaggattccatggctaagttccactaggcttctcataaatgtataccattacttacagggggaacaggcagaaaagggtagagaaaactgtataaaacagatcctttttatcttaaaaatcagctgaaactacatgttctactaatagactcaaagtatcattttcatctctgaattggtatacataacatagtctaaatatgttattaatatatatagggttagcttcgttgcacttagggtcctgagttacaaacaatccatgggttatacaggaggccatttcctgattagatgcctgcactagagtaggagctgaacagagacttaactgtagcataacattttaatacagctacaactagattacattctcacattctgttttagactgtggagtggaaaatacatccatcacttagaatgtgtgtaacccttatttaggttataccaggttgagccatttcacttaggacttagaggttagcccaacctctgacttctggtttccctctccaattttttttttgtttttgtttttgagacacagtttcacttttgttgcccaggttggagtgcaatggcgcgatcttggctcaccacaacctccgcctcccgggttcaaatgattctcttgccctagtctcctgagtagctgggattataggcatatgccaccacgcccagctaattttgtatttttagtagagatggggtttctccatattggtcaggctagtctcaaactcccgacctcaggtgatccacctgccttggcctcccaaggtgctgggattacaggcgtgaaccactgcacccgttttaatccctgtcgttgtcttctattaacagtcagactcatttggtagaaaatgaggaagacaggaaaagcctcatggagtggcctgactttgaagatgcagatttctctgcagttgaggaaagagcattctggccaagggaagagtgaagaggcaggaaagttgagggaagggtaaccatgttgttttgctaagtaaaatatacataaaggagaagaagaaaggaagttttaaaagacaagtttgggaaaaaatcatggaggactttgaatggcagcataaagggcatgagtagtaagaagctatgttaaacaatagccaatcaaaaccagattggggccaggaaggatggttcgtgctcgcaatctcagcactttgggaggccaaggtgggaggatggattgatcccaggaactggagaccagcctgggcaacatggtgagaccccatgtccacaaaaaataaaaaatagttagctgggcctggtggtgcatgcctgtggtactagctactctggaggctgaggtgggagatcactagagcccaggagttcaaggctgcagtgagctatgattgtgccactgcactccagcctgggtaactgagggagacactgtctcttgaaaataaacaaacaaaaaaactaaaaaccgtatttgtacttcttgaagatttagcagggtaaaatggatggaagaaagaggagactagcagagacaaattaacatgaagccactagaacgatttaaaggtgagtctgaaagaagaggcagcaataagtctgggaaggaggtcatgggtctaagacatgtcctctaagacagaggacaagaaaaacactgagtgaaggggataaggaaagttgttcccaggagcatccccttcccgggccctaaatcctaacaaacaccacaagtctgattataagtctttctaccttgcccccaaggctgtctttgaaaatagtaaaaatgtgtaggcctcagctataaaactgtcagaggcaattgtttgaatttggacatcaacgttatgatcaaaatgaaaatgtgtcactgactttgttgatgcatttttaaaagatgaacaggcttcgtttgttgacctgatgctccccagtttctgaatgtctggtcacctcaatggccctgagcagccccgtttctgaacatctggctatgcccccatgattagcctgcctggccccagcttgccctagaaaagggaaagctcagtagaaaaggcattctgggtggtttccatcttcttggagaagcagaagcaaaattattaacagagaatgagactggctgtagcaatgtgtaggtttcagtagagttgagaaaagctgtatcagagattagggtaggactttcatttaaaattaaaattgctggataatgtggcagtaactagtaaaacataaaatatgtatacttatgacccagcagtttcactttaagtgcccatactagagaagtactcatggcatatgagtattgtattatgcatatgagcatatgagaaatactagagtacataggaagtatgtaccgggatatttactaaagtgctatttgtaatagagaaaaggtagaaggaatctacacacacatcataggagaaaaactcagagagcatggtctacctgcatcacgggaaattctctaagcagttagaaagaatggggtatacctgtttctcctaaccaggtaagatctccaagacatggataagtgaaaataacaaatgcgcaatgatacatacgatatagcacattttggtgactcatttggacagaaaagggactggcaagatgcacatccttggtaacatagatcacatcaagggaggcagagaagtcatagcaaagagcactttagccttatcctctaataccttaatatttacaagtagaataagtatatggtaattgtttggtgttccaaaatttatttgaaaattttaaactccttagttctaaggagtcccttttcgcattaaatatcagatcttacaccaaagacatctttctttcaaaatgatcatttaaaagtcagtgaggcactggtgtaatgcaagacttaatggttgaataacaatagaaagaatgataaatacatagagagatagagagacagagagacagagagatagacaaatcagccaagctacttgcatagccagtttccccaagagctgccaattttatgcaagattattaaggcgactctgttcaataaaatgatggggcccccacaagttaggtagtgtagcaaaataaacatcaatggcatgccaccaaactgccaacacaggcaaatacttgcatatgtcatatttaaaaggcagagtgaaacatcaggaggctgagatgaggtccaggaatggagccgatttaaaatcagaactgaagaatgtaggccaggtgcggtggctcacgcctgtaaccccagcattttaggaggccagggcgggtggatcacgaagtcaggagttcaaaaccagcctggccaagatggtgaaaccccgtctctactaaaaatacaaaaattagccgggtgtggtggtgtgcgcctgtagttccagtactcgggaggctgaggcaggagaattgcttgaacccgggaggcggaggttgcagtgagccaagatcatgccactgcactccagcctgggctacagagtgagactccatctcaaaaaaaaaaaaaaaaaagaggaatctagactggagtttattcactggaatatttttctaggttcaaaaatcagtggtagcaaattattttctaaattagaaagtatatctgcaatactttcatatcagttcccatttagaggacaaggtagagctaatgcagttttaatacagtttagcagttaatgattattggcaaaatcatcttttgctcccttaggactttttcacttaaaaacttgatggtgtttggggtaaaatgtcgtaagagacattctagcacatgacagaaaagaaaatattaactcactatgtagccaagagatggattaatcttccaagcaattcaaaaagagaattggaacatgaactctaaaaaacagttcaagtatcctgaaaactgctaaaatagctctgtttggtgaatctcaggtattttggtcgcattgcttcaactccttaattcagaagttaagttttaatgtgagtcatttcagttttcatgtatttaaaagtcataaccactgaaacagtttttacaaaaatacttctttgagcctaatgttgaacacagtctgcactgctgagcatgtgagagtcactctgggaaaagggtgtttaatgaataactttacagtaaaaggccttgaaaacttactctaaacattagacccgtgctttctttctgaaatacattaacagcctccagaagcctcatagatgctggcaagcccttttaggcagacttttgaagtccctgacatttgtgtgcagggaaaggtgcctgcccgctctccaccccgcccccagcccctcccccacccaggcagtgtttggagatgctgttgacttaagagttttgctggaaagaaagattgataaagcaaagcaatcggagttattttctatgcatgaaattgattaaatgcttcactaaatggcttataaatttgcttctcatatttctgtcacccactgaaaagattacagaaactccgcatatagctatgttgtatacaataccaaattacaaaaggttgtaaaaactaatgttttgtttaaagttttgagcaggaccatatgccttcagtgaccttgagtaagctattttaattcaaaacatttcaaagaatataaaggggagaaatattcaactacataacaaaccagaccagtggtgggtagatctccgttaactgtgttgaacttctgctcttttctacgagggtgtagagtgaatcccatcatacaaacgccttatgtctggaaagcttggaagcacatgtggtgtcaatggggatatatttacaaaggagatgaaaaaagggctttaggacctcccaaagttgaacctgctctattatttttagttgagagacacatcctaatgagttctgagtctagcagagacttgtaaaactatgtagaaaaggtgacaaatattaacaagggtggtggggttgttttattttggaggaatttttgtttgcttgtttttaatctttacacgtctttcaaatgtcagctaagttctattctttctaccatgtgacaatttcttctaactattgtgtaacagttggaagggatgttagcatagagacgatttataagcaagcaggtgacctgcagatgctatggggaaactagcccttttcttaacatggccttaaaagtacctgccctgctacaggaaaaatgatattcttttacaacatttataagacatcatgtcctcagcaagaattaacatttggcattaacgaacgcacagttctggccataacttcaagaaaagaaattttacaaccagtaatgtgcttaaatccttcctgacctgccctctgtaatacatatccccaacctttcaccttcagaaatagccagtacggggacaaagatggctaccacagctatggccatctggagccccgtgagctagaaaagacgggggaagtactgtcaatggagggggcagaagtactttctaacatcagacccagcccaatgcccgtctgcttatgcagccagtttctgggtataggcaagtattgcactggaattatccctcatatatgaaaacacaatgtaatctcacttagcaaaacccaggtttctttctttttttatgagtacctgttctgggagatatgccaaaaattcagggataatttaaccaaaccatcaacaactggacaacttatttaactctttggtgagtgttacatgaacctttttgctggcgtcaagccaccacataatgaatcctgacgccagacacagagggtttgatacattagaataaaggaagaggttccttactatacaatatataaaagaactagcttctaccaacaggttgttgccatcttagaaaataggaatctgtgtctcctgaaagtctattccttgaacaccaatgctacaagcttatcctttataaaacggtttgggtaatcagatctattgaagatcaaatgtcctggggattcacagtgcatagtaatgtgctggaggctttgggggccctgctgcaaacaatcatatttaactcaggttaatctactgtttctcacttgaccccggacatttttttaaatcaatgttttgagacatgaaattactatttcaaacgtcttctggagaacactgatttaaatctactgcatggctgacaaacgagtccacctcttttgaaagctgagcaagcccctttaggaggacccttggctgaataaaggaagtctcaacccaactgcaagaaggtcttcgccattcctcttctgaggatatgctgaccttgggccgtgcatattctcttcttctaattaagacacgttgcatgttctgtggctaccaaagacgaaaacagtagacctcaccaattgcccatgggtttcacaagtggcactggttacctacataaatatttgtcatacatcaaataaatgcttcacgtacattgatttttcttatggactccttttcttttaagattatgtacaaatccactctctctttccacttcaaataatagacaaaagctatgtttattcttcctattctataaccaaagtcactcatacatcaagatcattcaagaaagcctagcagtatgcaagtgaatgagagtggcatgactgtgaagataatcttggatctactctaatttaatttttttaagtaaatcatttgcaaactccagcactctaactagtacaagtaacaaattacccatgaggagcctcagaggctacaggtgacagagctgtgttgcaacaccttggcaaggatctttgtactacagccttggttctcaaactgtacagtgcatcagaatcacctgagggctgtgttaaaacacagatctctaggccccacccctagtgagtttcagtttcagtgggtttagggaggggcccaagaatgtgcatttgcaacaggctcccaggtgatagggatgcagctgctctggctgggggacagcactttgggaattacaactgtacagcagttccctaatgctcccgatcaggattacctggaaactttgttaaaaacactaagtctcacccttagccccagactcctgagatggactctctaagaaggaaagtcaggaatctgtatttttaataaactccccaggggattcaaatcatccagctctggactacttcagcctgagaagaggggcttgccttttagatctgggcctgacgtcttgaacctttgccggcctctgggcacacggactctccctgctagaggccccttcaaagtgcaagcaggctgaagacacgtgaatgcctcctccaataacttgtccagtaattggtatattgattgctaatgtcatcatgttttagtatatataaacccctcactctattacacagcccccaacaatccaaaaagtcattgtttattcattgtgactcccaaactggcccttgtcagctcctgctggagagcttgctgataaaaatcagcagatgattggacgcacacattcttaacatgactgacccatgacatctcagagggcagctcgagagcctgtcattacagtacaatacatttctttcttctttcttatctagcccagatgacttcgagatttttattaactcattaatgactgaagatgtcattagaaccagtgggaagggttatttttctgtctctctctctctctcttttttttttttaagtgggaataagtgtgcaatttgctgggaaagggggaggggctcattgatgaaacagctaagacaaacctaagtggagagacccttggactttattagaatctgaaatttgattgacgggtcctggacctgaaaatctgcagacagaaatacaaagttgcttcagaaacatgttgggaagaatgggacaatttgatcaaggaaatagcgacccataaaattcagtaatttttattgtgttgtggactcaatctttccaacataacagctaaacaaacaaacaaaaacgtcagagtaaagctactgaaacctctaaatgtttcttaacctacacgttcattaaatcatatcttgtttctgcgtgcctttaattttcacatctgcaaaattgcttttagaaatcaaattagatcttttgaaggcacttaaattgcaacaaccttatgtttttttatatactcttgggtttcagccttttcatctgggttgtgtgtccaattaatgggatatctcaaggaagcactaatcattttgaaaacttaagaatataaaaagcaagcagactattttcattataactgattggattgagaataagctacagaggaaatgttcaataattatgataacttttttggaggagatcacaaaagaatgtcagtcacagaaggtgcttttcattgtgacaaaggctttcaagtccagtttcagtagattcctcttcggggttcagcctcaggcatgtcagaaggctgctctgagagtgggttttacactgatttttatcagccccagataattcacttggcaaagaaaacatctattactagatgtatctcatatgttactgaatgtttactaaattttactactgtcaaaacacattgtaaatgaacagaccctcagaagaacgagggaaatctattcctcagaagagaaaatggttgtctgaggacctacaaagatttttgcccaaggaaattaatgccagtaaactatgaccaagatttaaatatgctttcagccaagttttatgcttaaatcacctaattacatctttctttctttatttgcctggtggagaattatattcattacatgttatggtaaacagaataattagttaatatttacggattaattaaatacaatcattttatctaattcagtaataacggtgctgaattttatttttcacatttctgaacatgatgccaaacacccagatgaaacctaggaggagaaaagagtcaaaaatccagatgttattaaagatccagatgtatggtatcaagtaaacagaacatcaaggatttttacttttcttttttccattttcatccagatgtttggtgtcgtatagacaaagtcttaatctgttcagtcacaatcacagcgttatttaatatcatttgccaatatttcactcccttcttcacaaaatgatctctaaaaatcctatgtaatgcattcacgaggaaaacaaggatattttcttcagaaacaaaaatataatgcccagtggattcataagaccagattaccatccaggatggtgcccaagtctctatgttgaaaaacatttcatatctgcatttttaaatgatgaaagttaattcaccttaaatggttggaatggaaacttaattttaattgacatgcacatgcgaatttcagtcctagtaggtagctttggagaataacaggctctcaagtgtaaatgatggtcatcttttcaatgggatcctttcccaattcattcacttatcattaaatcctaaaagagattacccgccattttaagaataatttctgctttgcaactttgggtaccttaaagcactgacccagggacttaagaacttgatgctgagccccagcatctcatttttctgtgtgaccttgagccagtcacttaacgtctgagccccaattttctcttccttaaaaaaaaaaaaaattaaataatagacctgattctagtgaacccaaggatctaaaaacaagaacctggggagggcaaaatcctttatgaatataaaattatcagtaatacacggactattttgagttttacatatcattattacatgaatagtattactgtgtaaaagtgtcattactattaaaatgaaatccaagagggcacagtagagacagtcatgctaacaagacctggtcagctatttaccatttacaaattaaatacaggaatgactataatccctggatgtgcaaagcaataccagattctacttccttgtgctgccgtgtttcaccacgctaaatccgagaaatagtttgagtgctacccttttcatggtactaaacggactaatcataaggcatactgtatctctgattacaataggacacttctgccaatctaggaccctatgcttggctgactggtggacttaattttgacagacaaatgcaccctcctccctcctggccaatggcaaagactcaagcctttgcatagagcaaattgttgctgctgaatattcaaacagatctcatggtttccatcatgggagattgcttccactttttttttctgttagtaaaatgtacatcctaggaagttatcatcaaagaacaagctttttgctaacattcctctgcacagtataagagggtttctaagtgagaaatcaactcaagcacttgtaaaatgctaagcactaaaaatctctgaaacactttagtcttacacttttctgtaatggtgccgagattttgggaagagacatagaaacttttgagctgtgcgtttaagatattaaaagattctggaagtacaacaaagggaataaaataaatgaaaggaagatcacttcattaattttaactttaaaaaaaatctgcagtgtcaagatgctacagtcaaaaaacaaaaacaaaaactcacacatcaagaaatttctttcaaagtttagcccaactgtttgctcaattatatgactatagagaaaacgggatgaataatcaagttttagttcttcaactttgaaggcacaaatcgctcattagcatgttgctctgtttgatgcaacttattttgaagagccagaaatcaatacaaaaggaaacaataataataaaaggaaagatttctactgtcataatagggaaaggtgtgtgagctggaagaaagtacagtacagaagcccatgacaagtcatgataaatgggtcgttataaaattcacgtttaggcagcaccaggccgcggataatgccattcgtcatggcaacacgaggccgctaatgagccctcattgcatattcatgtttgtggcgtttcttccctcccaccctgaactagtgcctgcagatatctccacctcaagctgacgctcagcttaggtcttcttcttcttcttctctctctctctctcttttttttttttatttgttatgttgcagcaattacactgtaaaagtgctgcccaagattgattgctctgatctgtagttcaattgtaaattagaatacacatccccccagggacacacggcccctatttgtgattaagaaaaaagccccataatagactaatagctaaagttctctctcttttactttcaggcaattagcttgatgaaatggcctctttttgtgtaccctggaagtgtaaaccgatatcataatgaagtatatgatgtttattctattattttcaccttgctggatatgcaggaatgcataagtaatggctgctttgtctagtacgtttactgattcacaagtaaactatttcttaaagatgcagtgtacgctttctgaggcttgagttaagcaactcctaactgtggattaaccttcacgcaaatgtctactgcaggggaggaaaacgaatcccctaggttgggggagagcatgatgctgatattcaagaggcctccagccactggggcagctctgggatggatgtagtgacaaagtgcaagtgccagcactcaggatcactgaagacaccagggtactttggaaaagtgtcctatagtgattttaggcccaaagagactccacctgactacagtgtacccttcatctcccccagtgacttgtggaagaccaactcgctctcggctgtagggtggctgaagctcttcctacacaatggttatacagtcttttttttaattattattggattgcacccttgcgcccaccccccgggaaaaaataagtcttgccaaaacgttggcaagaaaatattcttcagcttcctacatgcaccagctgacacagagccaatgaatccacttgcagttggtgcattatcaaagctatttgtgttcttcctatgcaatatttcaatatatgttttgttttcatccatgaggatctcaaaattagagaaaaaaaaagggtgtcctacatgagaagatagaaaaaaaatagaaaagaagaaatagaagaaaaaaaaaagaaaaacaaaaatctatcttgctctaaagcgttttatggtgggtaacttaccaagatgttaattactgcttcaattctacattccaattgcccccgttcatccataacccagtttgtttcacctctcaaacccttcctaggtttgtgttgtctaaacaaatccatccttctcttctttaatatggatccaatttgagtttctagaaaatataaggaaatcacttttacggcaaaggatctcaataatttttaatgctgagtttgatgtgcacttttagatgtcttacattttgaaattaatatgtgagatagttgtttgtcacatataaaatgtgcttgcctttcctccagttacgtagctccttcttgattaaataaaacattttggggaaagtttgttactattttctggaaagtaattctattgtcacataatttccaaaaatactgcaaagtgagttaccaagaaatatttcatgaaaatttgctttatgccttcttttctaaaaatcaaaagtttttatcaatctttatttggggggttgactttctctttaatttgtacaacattgaactgccttctaaactataagcctgcaacacaataagtgtaaattttcactgctctcagaaacttttgaatgtctagccatattgccatatttgaaatatgctattttcaattttcaaatgatattgagcttgggtagggcctctccattcacttacataacctgtcatatttttaagtacactttttctagaataaaaatgcctcctatttacaaggtgctttataatgtttaaagttttttcagatagattgccttatataaataattctatgagataaatgagccaaataaccttattattaccacaaagttagtgggggagaaattatgactcagagaggttatgcaacttgcccagagtcacaggttagtaagtgccaagttgatccttgtccccaggtctttaactccaaaacgtgagctctttctggtacgcaatgctgcctcttcactaggtatacattccagaagcagcagctcaccaaaatctcacagctcttaacataaacaagatctgtgatctttatttatacatgggcaagattaacaaatgagtttaaagacacatatgtgcgcacacacacaagcccttcttgataaaaacacccaggaaaaaaggtaatgaaattcacactgctgctgggcacggtggttcacccctgtaatcccagcactttgggaggccaaggcgggtggatcatgaggtcaggagttcgagaccagcctggccaaggtggtaaaaccctgtctctaccaaaaaatacaaaaattagctgggcatggtggcacatgcctgtaatcccagctactcgagaggctgaggcaggagaatcgcttgaacctgggaggtggaggttatagtgagccgagatcgtgccattgcactccagcctggggggtgacagagggagactgtgtctcaaataaacaaacaaacaaacaaaaaactgaaattcacactgcattattacctaccaaacaacatttaagtaatctacgttagattataaacatatgcttagactgggtacataccaggcacaaaattgaagcaattatctacataattgaaattcgagggctgggggattaccactcttctcacagtccattagttggttttgtatgtccagagatttggttgagccttttcactaaacatctcttcaggcctttgcactgctattccctcagcccactcttaaaccatgtcacgtatgtccatctgagtaactcaatcctgaccaccaatctagattcagctcaaagatcacttctccctggagacagtccctgacttctatcaatccctttatccctgtgtcaaatacctctttgctttgctctccactaaggagcctccttcatcccagttttgaagccagtgaagacaggattcttgaagccagtgaagacaggatttggatctagaattcagcagatataaacattttaaactgtgtgctagacctgtctgccaaggtacctcccatgctcaagaccctctgtgtaccaaagagccacgttcagagccccgggattagcaaagcagctctaggctattctttgcaaagtaatggccaccatttcagtcagcagtgggcatctaacctacggtttgcccattgttggagtagccttgagatgacaacttcaccaataaaacacctagagcagaaaccactgaagtacacagaatcatgtcggccatgaattttttttttttttttttttgagacggagttttgctcttgtcccccaggctggagtgcaatggcgctatctgggttcactgcaacctccacctcctgggttcaagcaattttcctgcctcacctgcctcagcctcccaagtagctgggattataggcatgtgccaccacacccggctaatttctaattttgtatttttagtagagacgggttttctccatgttggtcaggctggtctcacaatccccaggtgatccgcccacctcggcctcccaaattgctgggattacaagtatgagccaccacactcagcccagccatgatttttatgcaaaatgattgctgcctgaacttgagaaagaaataactccagaaatgatcccaaaacactctatagatacttccaaatctcaggtgtagcattacctaaacatagaagaaataagggcatatgtcactatttctttcatttattcatgttttcattgattcaataattcattcaacaaatgcttattgagccttcaggagataatcataaaaatgacatcattctggccctcatggaacttacagtttaatgggagagataaatattatataatcgcaccaatgaatagaaaattgcatacaataataaatacacaaagtaaaagtaagaataaagtggaacttacagtgaagccttcatataaacaagtgcttcagcatagaaggtcttgcaatagaagcctgaagaatgaggttatagataaaagtatcaggaaaaatgaaaacatttccaaaaacatgtggaaaggtccaggagtaggaaacagcttggaagttaaagaaataataaacaggccagcatgcttggaccactaggacctggagataaagcagaacgtgatgagacataggtgagcagagccacatcacagagggccttgtagaccacatgcttaggtaggaattttggatgccaccttaagtctagtgtaaagcaattgaggggttctaagcaggaaaggccgatgataagacccacagcagcttagagggtgatagtgttgtctcattttgaataagaaacctcaatttgttaggaaagaaaaatacaactgttatatttttccaacaccaactaaccaaccatgctctaggaaaacacttcaccttcactgggggaaagcaaacccctcttcaccccatgtcttatgtgagcccaacaccaggcctgccagcattgaatggagaagatctgacaccaggtatgatatcaaagagcttttttttttttgagacagaggctcactctgtcacccaggctggagtgcagtggtcactgcagcctttaccccctgggctcaactgatcctcccacctcagcttcccgagtagctgggaccacaggtgcatgccaccatgcccagctaatttttgtattttttgtagagagggggtttcgccgtgtcacccaggctggtctcaaactcctgagctcaagccatcctcccacctaggcctcccaaagtgctgatattacaggcattagccaccacgtccggccttcaaagagcttttgaatcagttctgagaaacattgactgctctcgtgacggcaagccatctgctcaaatgcgatagcacaactagaagatgctttacggggtctgcatgaaaaatagtcagagattggttcaaagaacccataaagtagtcatgctgagcgtcttgagatgctggccttgacctcatgacacactcctgagtcactttcctagacccactgatctggttaggacccacccacgccgaaccacagctccctgttagagcacgttgctgtcatcgctcattaatggtcttatctcctgcactcagcagtgagctccacagaacaggaagagcatgcatcttattcacctaatgcctaatgcctgatacagtgcagggcacttttaggtgcttagtcatattggtgtgtttcatttgtgttatggtatgcagctacgtgttgtaattgttgatttgattttctatctcctcctgtgagttcttcgcgagtataatccatgcctccatctttgcgtctccactttatcaaagaggctggctcatagttggcacttgattcggattgattaattgattagttaattaacgtatggctaaagcaattaggtataaaggaccttcctaaatgcaaccagctctacttctcttttagtcaatcacaagatgcgtaaaaccacattgtctgagaatcttgcatatcatcaatattcattggtgagagatgctttcttaacgctggtgttttatgcatttctacatgttattatacaccccagaaaagagtgcatgtaaaactgctgaagcctgaataaagcctctaactgagttaacaatattgaatcaatttcctaatgtttagaatgtgctgtggttatgtgaaatgctgtctttggggaaagccgggtgaagggtacaggggatctctccgaattatttttacaacttcagtgagtcctatattatttcaaaataaaatgtgataatttttaaacactttctgatttttatgtttatacttttacatatatttgcatatatttctataatatctaaaatgtagttgaaatgtcacaaataataattaaatgatgttatcatatattacactagcatacaggaaagaaaatgccctaatttggggcactattctttttgtctggctaggttggcatttaaaatatgctaggagaggaaggagatgcattacttttgcctgattcaagcatattttcgaaatgatgttttcataaacaaagtgccaacagctatgatcttatcttctctcttctttttatcctaattcaggtcaataacaagtatttctgctctcttctgcagattctaggttttggaagagaggatgcaattatgagcaacggggaactgttagtgaaaaattcaccaagaagtcagagagtgcctttaaacttctttctacccagtgttgtcctattaagaaaataatgtcagtttcagagagtgatgttttaaataaataaggctagcgtttacagtagcgctggagttttaaattacatgttcaagatcccattgttggttacatggataacaatgtaggtgatcacatctaaactctgaaacatggtaggcaattcttctactacctgagagatctgaaagccaccaacaaaaaaatccatacggcagattaaggtaaaatttcaatatgtcttaaactgcttaaacatgtaagttcaacccccaccccccccaaaaaaaacactcttttagcataaagagctgcagtttccaatcctattcaattaattagtttcctgtagtcaatcaaatgaaaattctgaaatagcctgtagatgtcataaacctaaagtcaaattcaaagatgaatgacattctcccacacgcttccttctttttctggaaactgcaaactcattagtaggtacatctaagaagtatacctgcccagaagtccctgtagttttgtgataacctatgtaaaataagttcggctcaaggtatggcatggtagcttcatcctacagacccaccggtttatcccggagagattctgaaggacaaagtaaaataaccaggtgcaggaaaagagtgcctctctgcttgctaaagctcattagagaagggcatccatctttagtccttcaggataatatccatgagctgtaaaaatagagttttacttagtaaaggaaggggagaataaatgcaagaatgttcttaggatctggcgtattgaatcatgaatcaaagaagaagaaactataattacctctcgttccatcgaacagagaaatttcttccacacgatcttttgtgtggcaaggataaagcttcattccagagaaaatccagttaaaatatcccaaaagaaataaaatacaagatcctgcagctctttaatgcttgctactggccaaatcctgcaattagaatcagtcactttaagtgctgaagtcgtacaacgctaatagatcactttctaaagtgagcagttttttaaagttgtatttaattttccatcattacagtactgaatgccagttgtgtctgtccattctgatataggttcttaaatctccaaagggtacagactactgcttgcctaggcattgcttaattctggctttaattctcagagacctgaattagagctgtaaaatggaatgtatttcaactttttccctaaatgtgtttatttttattttcaaaccaaatgattagggctcctttttatttcataattattttatttcaaaaaaatagaaattgaggtgaggtgtgtatgtctgaatgtgtgtgtgcacatgcacatgtgtgtgtggttttaagaaaatgaaatgaaccagaaaataagcccttagcagtaacctaagaaataaaacaaaatcatttacaacacatgggattgttgcaggatatgtcaagattagatggttttaagggagctatcctgaatgtggaagcaattataatgaaattcatgactcattagcaaacattccatattgtgtttctcatttctgggtcaatgttactagaaaatatagacttaagatttagatgtttcattgacttcaatgccagattatagatagttgggttgtacaatgacataaagcaaagactccaggattttgaagttcttcacttctcagatataggcaatttggtcttaagatacctatgagcaaagtaacttcaaaaatgtattggtaagaattaagttggtgatagaagggttgtctgtaaatgtaaagaattacctggtgcaaatgcatacgggtggatgtcggtggggattttgcgtgcacactgcttggtatgcaatatggctggtgaactcaagtacccaatactgtacgtaatgggaaccagatgtctaacagagagagaaaaatattttatagcaataaatgtgacattgactcttaaagggtttgctgtttttaaacaacttcccagtcttactttccctcatattttaatgtagtttaaagtagattgtgtaaggaaattattttcacattttaaaagaaaaagcatttaacttgccactaacttataaaatgcagacataaggagaaatgatctgaataagataattttggaattcattcatttacaaaagcactatgctcagcaatgtaaaaactaaaaaaaatattaaggcaaataaagcataattcctcctgcccttaaggaactcaaaacatgctagatatgataagatgcacataactggatggggacatggcagaagcaaaccctaggaaagacgcccagagtgctccgagaattccaagaaggaaaagaaaaggcgatgcgatggccagcaggttccatgaaggagggtcccgctggtccatcctgtatcctgttcaacatctcccccatccaccccgtcctcttcacgtcactaggccaccttggtgaaggccctcctgctctctggccaatgcaggggtctccagtagctcggcagctttgctctctcagtgtccccacactcacactccatgcaaccctgactttgctgccagggtagttgttcagaagcactaatccagctgggaagtggggtgccccgatgattagattgcaagctctgtaatgaagcttggggttcacttcctgctttgatgtttattggttgtgaccttggagaagtcacttaacctatctccctcgatctgctttttcgcctctgtaacagcacatgtattatatgcttggagtcaggatttcacgagctgctgcacaccatgtgctttccacagcatcagcatggagtcggggcactgttggaaactcttttagctgttatctgatcagtcatccaatccagtttgtttgtttgtttgagacagagtctcactctgttgcccaggttggagtgcagtggcgcgatctcggctcactgcaacttctgcctcccagattaaagcaattcttctgcctcagcctccctcgcagccggaactacaggtgcccgctaccatgctcagataatgtttgtatttttagtagagaaggggtttcgccatgttggccaggctggtctcgaactcctgacctcaagtgatccaccaaacttagcctcccaaagtgctaggattacaggcatgagccaccacaccgggccgaatctagtttttacagagcaaaatccaaagcctctatttcggtatgcgagactgctcgtgagctggcacttgcatatttctccaattctttctcttgatcccttccattaaatactcaactttcttgctatccttgtcagcttgtctttgtccaagcaggccttctgtgcccaagccccatgcctctgcacatgctgttgcccctgccttaggtgctccacctcccttcttcctctctactttgcaaatttctgcttaccctgcaggtctcccctctagcagatctttctgatcttccctgatatcctgtgaaagaacaagagcctccttccactaggccatgttcttaaactcacagggcccacacaaacagcataaataaatgaagcagtacaggataaaactgtaaggagtagtggggactgtagttaaaaaggagaactcatttatttctttcttttttttttttttttttttttgatatggagtctcattctgtcacccaggctggagtgcagtggcacaatcttggctcactgcaaccacttcctcttctgcttcccaggttcaagggattctcctgcctcagcctcctgagtagctgggattgtaggcacctgccaccacacctgactaatttttgtatttcaagtagagacagggtttcactattttggccaggctggtttcgaactcctaacctcaagtgatccgcccaccttggcctcccaaagtgttgggattgcaggcatgaacctgtaatgggattacagacatgaaccatgcccagcaggagaagtcatttcattctctggttaaaagatcagccatccctcactgttaccatggtggaataggggctaattattgtcaattctttcattttttcaaggtaagacagaaatctgtatttttatctaaaatctccagtgttcattgttggtaactaaaaagaaaaatcaaatactatgactttagaacaactaaaaccccccggggaccaagtggctaactgcatgcagaccttggctcatggaatgccttattctgggatttccttgcaggtgcacaccaccaatctggcaaatttaactttgccctctaattgtttgcacatctacttccccaacaaacgatgctcttgaggataaggatcatgtagggttacctttgtcttcccaagttgcctagcacagtgggtggctcaaagaagcatctcactaaatttcatgtggatattttccagagccttgaagccggggaagggtctgctgatggcaggtcattccaggcacattaaaagataaagatattccaaatgtccccgtttctagaaaggaatgattttacagatactgtaagccttagtctacatttgacttcctcaggaccatctggaactcttcctatgatggctgcaaagtccactccatcactggcaacactccagccagctctcaaaatataaatctaatccataaatctaggctatatataaacttaatctatacctgacaagtaagtgaatacctaaatgaattaattaactttacccaaagagtctcaactcaaatgtcagatgtgatgttttaattttgtcggaaagtgaacatagaccacatcctggacccagaaagaaacatgttttctctaaatctgaggccaagaagacaatggataaggctagggtggtgggcaacactgaagattcagagacagccatcctactgtatgttttttgtttgtttgtttgttttgtttttgagacacagtcttgttctgtcactcaatctggagtgcagtggtgtgatcttggctcactgcaacctccgcctcccgagttccagcgattctcctgcctcagcctcctgagtagctgggattacaggcgccagtcaccaagcccagctaatttttgtatttttagtagagatggggtttcaccatcttggccaggctggattcaaactgctgaccttgtgatctgcctgcctcggcctcccaaagtgctgggattacaggcatgagccaccaagcctggctcctagtgtatgttttttaaaaaattttatgtccataatctttgatccaataatgcaacttcttggcatttttctcaaagaataatcatgtgcaaatatttgactgtaaggatgttcactgccattctgtttataatgttgaaaatagaggccgggtatggtgtctcatgctcgtaatcccagcaatttgggaggctgaggtggtcagatcactcgagggtaggagttcgagaccagcctgaccaatgtggtgaaacctcatctctactaaaaatacaaaagaggcaggagaattgcttgaacccaggaggcagaggttgcagtgagctgagatcgcaccattgcactccagcctaggcaacaagagcaaaactccatgaaagaagaagaagaagaagaagaagaagaagaagaagaagaagaagaaaaagaagaaggagaaggagaaggagaagaagaagaagaagaagaagaagaagaagaagaagaagaagaagaagaggaagaggaagaggaagaggaagaggaagaagaagaagaagaggaagaagaagaagaaggaggaggaggaggcaggggaggatgtggaaaatagaagggttgttacatgagcagtaacagaatactggtttcatgattataaataatgagaggtgaaatctactgacccctcacttatatgacagaaaatgtgctgtgaactttaagaatcattacatcatttaaccttattgttgtgcctatcttacagaggagggaactgaggcatagggtgtttaaataatttgcccaaatcacatagccaacaatgtcagggcagggcattggaactcagtactctttaacaccagagctcaagcttctcccgcaaattgcacttctcccatcaatattgagacatccacaatagtcactgtgcagccatgaaaattataatctaggaggacatatgatgactcagaaaaaaacgatgatgtatttttcagtgaccaaagcctgtgcctgtcattctgcacaggcattgttagatgaaaatatcagaatcccatagacactgctccattaaagacgaatattaggtaaggatgcaaggcgattccacaaaattccctgcagggatcagtgccaggatacaaggagtctctgcccctagaactccgccatctcttcctctgcttcttactgtctcctctactcatctcttgcaaaccaccttctccactaaagctttagctttcgaggtacaaattctaatcccgtgttgatacggcttggctgtgtcccaacccaaatctcaccttgaattgtaataatccccatgtgtcaagggaggggccaggtggagacaattgaatcataggggtggtctcccccatactgttctcctgatagtgaataagtctcgtgagttctgatggttttataaaggggacttcccctgcacaaactctcttgcctgctgccatgtaagacatgcctttgcttcccctttaccttctgccataattgaggcctccccagccatatggaactgtgagtccattaaacctctttccttgacagattacccagtctcgggtatgtctttattagcagcatgagaatagactaatacatatgccaatgtgctgcatacaatctaatttaatcccagggaaagagcagggactagcccagctgggccagatgtccacacctgttccaatcagctggggccagggaatagaattctgtagaactggttcagtaaaataggaagtagctcagacggaagcactgaccatctaagtggtgatgctacatttttggatataaaaaccataattagaaagaaaaaagatgagaaaggcccacatcaagttgttaacaatgtttctgtctacagtatttgttttcttatttttgcttgtctctgtgttctaaattttctaaagtggacatatatcactttatactaagaggataaaagagacccagcctacatgggaattaaaaatgaatgtcccctggccaggcacagtggctcatgcctgtcatcccagcatgttgggaggccaaggcaggcatccgcttgaggccaggagtttgagaccagcttggccaacatgactaaaaatgtttatatttttagtagaaaaaatacaaaatttttagaattcagtagaataatacaagaattttttgtagaaaaatttagtagaaaaatacaaaatttttccactaaaaatacaaaaattagctcagtgtcatggcacaagcctgtaatcccagctactcaggaggctgaggcacaagaatcgcttgaacccggaaggcagaggttgcaataagctgagaatgcaccactgcactccaactggggcaacagagcaagactccatctcaaaacaaaacaaaacagaaacaaagaatgtcccaagtgggtgctattaggagactaaaggcccaaatcaagattaaaagtaatttcagcaatgatggaatatagtaaatgcttaccaaagaaaggttagcagctgaaccgcaaaccccacctgacagcccttggattggagcaagcttcatcatgaagatctcaaagctgtatctggtggagatgccgggcattgtggcaccagggcccactgtcccatgacactgtgctggacaactggctcctgggataagacaagtcagagcagagaagggcgtgagtcacgtggaatataagataggatttgaggaggcaagagacagtggccataaagaaggaaaacaagatgaatatgtatattgcaagcagttgactgaggaatgagacaagggcagagagaagttcactggtctgaaaactggcaatggagtagcaagtatgtagggaaggagaaggggaggtgaatctttttttttttttttttttttttttaaatttattgctctgtcaccaggctggagtgcagtggcgtggtctcagctcactgcaacctctgcctcctgggttcaggcgattctcctgcctcagcctcccgaggagctggcattacaggtgcccatgacaacacccaaataattttttgtatttttagtagcaacgggatttcaccatgttagccaggatggtctcgaatctcccgaccttgtgattcgcccgactcggcctcccaaagtactgggattacaggcgtgagccaccaccgcacctggcccgaatctttttcatgcacagaaaggataaagtcacagcagaagaacaaaaaaggcaaggtttttggaccattgcagaatgatgtaattgaaataaaggacaattggtcataccaaggcggggcagaggaggataaataaatcattgagcacagacatagaagtttgaataaggcgagtaagcacccccactccagagtaagggaaccttggccactgctgtcctatttgccttcaatgctctccaaatgatcagtggccacaggccttccgaagtacactctgtctgtgacctacacgaatgcgagtgttcatcttgtatcccacttggtacccattcttctatcacctcactcacctggtgaatgggtacttattttattacttttcacagaatacttaattgactttgatagcttcaacgagattggagattggaagctcctggagatgagaggctgggagtagctgacaccatgattggacacttcagcagttttaaaacatgtccatgagttctttaacactccccacatccagaggaggtatctaaatgccctgcccttgaatctgagctgatcttagtgattggtggacaatagaaaaggtcacttggtaggtcaaaaaggataatttgggccgggtgcagtgtctcacacctgtaatgacagcactttgggaggccgaggcgggcagatcacttgaggtcaggagttcgagaccagactgggcaacatgttgaaaccgcttctctactaaaaacacaaaaattagccaggcgtggtggcgggcgcctgtaatcccagctactctggaggctgaggcaagagaatcgcttgaacccgggaggtggaggttgcagtgagctgagatcacgccactgcactccagcctgggcgacagagtgagactccatctcaagaaaaaaaataaaataaaataaagaatcattcagcctcaaccttactctcttgggacactcatctttggagtcctgagtggccatgtgagaagtgcaaggatgagatgccgtgaggaagttcagattacatggagtgaccccatgcaggggttccagttgacagccccagctgaggtcgcagccatggccaacatcaaccagcagacatgagagtgaggcagcctcagtgatgactccagccttggcctccgccagacctcatctttatcctcaagaaagactgtgtgggaaccacccagctgatcccagtcaacactcaaaacaatgacagatcatcataacttgatttttgtgattttaagttaataaatttcagggcgatttgtcatgcagaaatagataactggattagatatagttggttctcaatacgtttctattaaatttcatccaatagcagataagagacggcaacattgtctcttgatctttttctccctttttgtctaactccttgctcttttgttccttggtcagtctctccttatatcctttctctctctctctctctctctctctcactttttctctctctctctctctgcaaattcagaattctccccttcttttgcggccatggaagctggagaaaacagatcttccatccagatagccagggctctctctctatctataaaaggcctctgttttctctcttttggcataaagaaactcaattcctttgtttttaactgctcccatttctctgttctgtactgacttgattcctccttcctgaatgatctttgagtcttctgtgtactttttaggttgtaaaacaaagaacaagacaccctaccccagcgatgatcttggctataacattaccctcatctggaaagcgctgttatttttggccaccttcggatcttcgtgtagctgttccacccctctgctgcaggagctccgactcacttccccaggcagtccagggggtctgtagacagcagctgcatgaggagcttgagtgggaagacagcaagccgggtggtcagaagaatctctgtgaggatgcggcttcaaatgaagcagtgtgggcgggaatgcatgaaccctgtggcctggaggctgcctggctcgccttacccagagaaggagtgactcatagaatggtcgctgagcagctgatcaagtatggaggctgagggagacccagaaactggaccggaaatcttcccccacccccaatgtgaaaggacgtctgttccatctgcgttgcccctcagaggtggcctgaccactgcctgagagtgtcaccctggggcaagcctaggtgggcacgcgtcgaccgcttcacacccttgctcaaacacacagcatcgtgcatgagcacagagctgcttgacagaaagaggaagaagccagcccccaggaatggcaaacacgttgcgaaaaggaccgcgtgcagggttggccgggtgcactggcagcagccaggcaatatcatctcaggtcaaggagaaagccccatggccaaaaatagccgcgctgcccagttgccacagtgtctaaaattacaccattggagatttattcctttgcgcacctcacctttgctgggggcgggtccggggaggacccacgaaatgtcttcacattaaggtgcaaaaggcctggcagctccacagagttatttgggggcgggaaaggagggaggtgttgaaagggcaggaacaaggagaggaagtgctgggaagggacagcgctgggcagcttctcctatttcagagtttcaccctgaaggagcctagctggcagctacatcataaaactgaggcctaagcaatttgccagtaaatttgaaccatgcatgtaaacaattctaataatttattccttgaaatgtttcctatcatatattattatgcagagctgcacatgctctatttcaaattgcctaaacgaaaaaaaaaacgtacattaagggacaattaaaaagaataacaagaggcaacatgaggaaacagtgtatgcatatgccagtcaggctggaacacagagggaagccgaaggcagccaggcagcccgttgcaaccaaaggcttgatttctggggcaagattccctcggaaattcaggcaaggactgtctttatacgtagaagtttcggtaacttgaccccagcagattaagcagtaaacaaaataaaagcagacaatcactattcgaaagccacatccagtccgctgcatcaatacacaacagctccactgtaaaagttcctaagacatagataagaatttcagaaaggtatgtccaccctgcttgagccacctccgggacagaaagctaagtcccatggatgccctggtgggctttaggcaggggcagggataaactagggaatggaaggaagcagaacatgaggaagggaacgagggaaaaatgaaagagcagagcctgacactgggaacagctggttccctcaagaataaccacacctctacaccatttggcagtttaaaaagaacttccacgttaactttgccttcaaacctccaactcccatgaaggaagaaagtttactctcatttttataaaggagggttctgtggatgagagcaattaggtaacttgcccaaggacacacagctggtaagctggggaccatggtcaggtcttgaaacccagtctaactaactacagcccctgctttgtttattcccacagtgttgggagttacagaacacggggattcaagaaatgatccccctgaatccactgagtaaattcctggtgattttagtaactaaggctttccttctcaaccttaattcatttatgcactcaacaaataatgattgagcctcaacaactactgggcattgtttcggagctggagttcaccttcatggagatttcacataaggggctccttgacagctgatggcaactgtcctcttttcagagagccactccctgactgtgcaatgcaaatcggctccagccacctttcaatcttcccgtaatacttaataccatctgaaaccatgaggttcatagatttattcactatattactgcttatctccttctctagaaaagtaagtccttcagaaaaatgacccagtcttatgtgaagctgactctccaaaattagaacagttcttgcacataatagatgctcaataaatatttgtccaataaatgacactgaatgccaaggaaagctttttaccagtgcctactatgttcataaaatagtgtgagactaattacataaatcatttcattaaatcaagattatatatgccaaaatagaaaatatatgaagaaaatagggttttaatattagtgaagaaactgcttggaagaaataagggtccatttgtaatgcttctatcctgtgccacttaatgcaagaacaagggctattttgtgacattaaaaagcaacaaatttaaaaccaagaaaaggaaatactttttaaagcagcgtataatctacctgtggaattcagtgccgcaggatattattgaggcaaatagtctagcaagattcaagaaaggattagacatttatatgaataggaataatattggtagttacactaactaagttaaaaagttacaaggcatgtccgtcctgggctccagggcatagctgttcaccagctggagtgaggaaggaatttccccctgggatagagcattgcagaactggccagatgcacgatggctcgtatttttgccgtcttctgtaacataggcagggaccactgccaaggggaagtttctagagtagatggaccaatgacctctaaacatggtgtttctgtcttctccttgaacagtcctgaataggacatggaggttgcatgtaaagtcttttgggattcgtacctgagaatttttcaatttcaaaaaacagaaattgacaggtaaaaataacttgcctcttcctaatgacaaaaatattacatggaatgaaatcatgccctgcctgtaatctcattagcagcatagccaatagtgccaggaggctgcctgaatgcttccaaacctcaacacatcggagtctttgtagaatctcatacaaggacatcatctacccatgttttacatccatctatcactgtgccttatgtgcttgtgcttaacacaggtgtttaacgaaaatgcatttctgcagatgtgaacaaagcctctcattatgctgtccactcacctagcaaagcttctctctttattacatagtcaattacactgccaggcacaacctttgattcttggtgatgtatgccatgcatttttttcattctaacatgaaaaatccaaaaggtagttgttagccatgcaaccaaatacaagtgttcacaatggtatggtatcatattaatgaaaacattgaaactaaattatgcattatacttgcttactttaccgacctcagttttccaggtgtagacaacactctgaagaaactgcatcagtatttaaattattagagatacaggccaggtgcggtggctcatgctgggaatcctagcactttgggaggcccaggcaggtggaccacttgaggtcaggaattcaagatgaccagcctagccagcatagtgaaatctccatctctactaaaaatacaaaaattagctgggcatgatggcgtgtgcctgtagtcccagatactctggaggctgaggaaggagaatggcttgatcctgggaggcagaggttgcagtaagccaagatcgtgccactacactccagcctgggtgacagagcgagactctgtctcaaaaaaaaaaaaaaaaaattattagaaaaaggaaagtcctctctctgaggtataaagaacattctggaagccaaaacagaaagggaaattttagtttaaatcttaaaccagcaataaacctaaaattttcaaagtttcctgaaaaaaagataaaattaaaatatatacagcaaaatgttgaataatgttaatatatgtgtttttctggagagagagagaaagagaaaccatagattccattaatatcttcagctatgttctcacacaatataagttaagaaagttaaggaacactaacctaggacccagtccaaaagaaaattctcacctaagtctggacaaagtcctttcaaagtcctttgcaactacatgtaagacttgttcccttgaactccttaaattagcagaataatatcaattagattcttttggtcaaaaatcattcatatagggtctaatccccatccagagaaaaaaaaaccttaaaacatttaagtgttgaaggctacctgtcattttattaactggttgcaaatacgcttttttaggtttggccgttttctcagtctaagctttcctattttctcatgtggttattataagagaagagcttctctgatttttgtttgctggtgtgggtttttttttttttttttggttgttaatgtttgttttttacttataaccacatattatgaggaatgataaggtattataaattaatagtgtaagctctgtaatcaattaggatgggttgaaatctcacactagactccaaataaaccaattagtctccccaggcctctcttttttaatctataaaatggagatataataatatccaccacacaaagtctgtgtacaaaataaatgagacaatgcctgtaaaacatgtggcattgtgcttgtcatatattaagtagacaataaatattacctattagtatgactacgtatattttgcctatgtatttataagcattaagagtgcatatcctgtttccttattatcacatagttctcatacatttttatgggcccttgatgcacactgcaaatgaatttccaaaaggattttgctaatatatcctatcagcaatatgacagtgtcagttttaccactccttggttaaaaatgggaattactattaaccaggaataaaagaaaaagaccaaaaaaaacaaaaaaagcggggaaaaaaaggaaggcaagaaagaaaagataatttaattttttttaaatgtgtacatgtaagcttttgcgtttctatatctaggaaaagaaatctgtgaatgttcagatttccattcgacatcagccagtttctttccaaacactttctcaaagtgtcgtacttcatctttcaaaaagcctcatcctacagtcacacaccttgtagttttccggctgagggactcacagaagggaaccgtggtttcctggttctctgccagatgtccagtggtcccacgaaggccagagattcaactgcctgccactcttgtgaagatgttgcatacaggacgattcccagaggaactgggacctggtgaggccaacacacagatattttcttgtaaggtaggataaggcagagtgacacagcccgcatctgaccacaagtcatgggaggtgtaacccaaggtggcttatcacctgagctctgaaagggataatctgggaggaacagttggtttgtgcagcttttcaagagacttaaataatacctggttttgtgggaagagaaggaacaaaagaaaagaaagcaaaaccctgggcacgatggctcacacctggaatcccagcactttgggaggccagggcaggcagatcacgaggtcaggagttcaagatcagcccagccaacatggtgaaaccccgtccctactaaaaaaacaaaacattagccaggcgtggtgtcgggtgcctgtaaccccagctacttgggaggatgaggcaggagaattgctttaactggggaggcggaaggttgcaatgagccgagattgcaccactgcgctccagcctggatgacagagcaagactccctctgtctaaaaaaaaaaaaaaaaaaaaaagaagaagaagaagaaaagaaaaagaaagcaagaaaacactttagttgtgggtactggatttactgcatgtcagagtggggagattgacagtgttgacttggaaatattctaattctaggcaaccaaatggaggcttttcctcaccttctccacaccaatgtctggctggccccctctttcttttaaaacagttcctggggaggccccaaaattcatctgatgtctgtatgagcactgttctaataagaaaacagtgacctccctgttttttgtttttttttacttttttattttctggtttttgttttttgtttttttgagatggagtttccctctgttgcccaagctggagttcagtggcatgatctcagctcactgcaacctccgcgtcttgggtgcaggcaattctgcctgagcctcccgagtagctgggactacaggcgcgcaccaccaccacgcccggctaattttttgtatttttagtagagatggggtttcaccatgttggccaggatggtctcgatctcttgacctcgtgatccacccgcctcagcctcccaaagcctccctgcttattcacacaaatccctgaataagaactctcttccaggtggacatgatttatagggctgattcaacggcttctcctaccttaattaccatgaaggactcacattaaaatgcttagaaaagatgagagttgggctcttttgacttttgctggtggtgtggattacctgctatattcctgaatctggcgcttgctaaagaggttgagaggatttgcactccaagatggggaccactggcatgacctttttccttggctctgtggtcaagccaccccctgctccacttactacctgagtgacaccaggcaatcatttcacctctctagacctctgccacctaattcagtacgtggagatagtcacacctgccttgcagagttattgtgagggaagcaccagcttctggtacatgggagattttatttatacatgaacacatatatgcttgcatacacacagatgtgtaccgcagtttttgaaaatcatctccatttttatagctcacaaggtgatttttgaaaagtcaatcaagaaaagaagaaaaaaaccattttcctctccaacaagaaaaagcaattaaacgtcaaatattaactgttccctgggagaaaatttttttaatgggttaaaggcttggccattatagacctccaatatgtaatttctaagaaaggaccaggtaatatatttttttaaattaagtggaagacaaaatgctggaaccagtgaatccattcagaaagcgcttttttatccattttccgtagcttcccaattgcatcatgccttttaagaggcccaatttgtttaacagcattttattttaaaccttcacttgtgaaaagcattgatttatgatagggctgattaaagcaatggtgtcttaagcaataatgatttcaattataggactttcaccaacgtgcattattctgatttgctctccattcttgccacatttttattcacaaagaaaggggtagggataggtgatgtaattttgaaaagtccctggacaaatttaatatcagaaaggaatgtatagacagatggactgatgtaccttttttgattatgtgaatgtattgtattttaataagctctgacaaactcttcaacagctccctgatgagctcctacttggtatcattagggttatttagtgcttagattcggctcaattcccactggagccacactgaggttgtagaaatgtgcacactacagattcactcgaagcctagcacttagagtcttatctttttgtgaagctggagaaaacaattaagctcacacttagatctttaacttgttcaaagtcaacagccatagaaaggcacactaggctgggtgtggtggctcacccctgtaatcccagcactttgggaggccaagacacgtagatcacttgaggtcaagagttggagacaagcctggccactgtggtgaaaccctgtatctactaaaaatacacaacttaggtggatgtgatggtgggcacctgtaatcccagctactcgggaggttgaggcatgagaatcgcttcaacccgggaggtggaggttgcagtgagctcacccccctgcatgtagagacatggcaaaaccctgtctctacaacagatacaaatattagatggggatggtggtgctagttccagttacacaggaggctgaggtggaaggattgcttgagcctcaggagatagaatctgcagtgagctatgatctcaccactgcactttaccctgagcgacagagtgagacactgtctcaaaaaaaaaaaaaagaaaaaaagaaaaaatgtgaagtcagcctggagtcatatgcaacggaattcagggtatccatctaaatctaattcagaatgcaacctaacatggtgggggtggggggtggcgttgggaggcgcagggggtaatctatcacatttattaataatggcaacctgtgaaggagccctgcctaacgggggctgctattcctaatagtcactatgcacagctgttgaccaaacagtgccacaacttcggaattcagaaattcatattgttatgcaaagttgaaggttcttgattttaaagagtggataaacactggcccaattcagcctgcaggctgcctgtgcaatgctccctagttggtgcacaactggccaatcaatcaagttattgaacagaagataggcccaaaacagcaccatgctctgcaagaacctttttaaaaatgatcaaagtatttcaattcttctactatgcaaacatttagtgggaatctgttatgtgctaagaaccatgagtggagtactgggaacacacaaaaagaataatatccattagccctcaaggggatgacagtctgttatttacatatatgaactatgagagattttgggttaaaaaactagggagaaatgcagtctaacattgagtcccaatccatcacgcttatttttagttaagaacctcctttgttaccctttaggtaaattagtttgtccctattctctgctttaaagcatcattttaatttgagagctagtcctatgaataccaaagtccatgtaggatatattcctcttaaaatccccaacagcaattggaagggaaaattccaatcacaccttgatagaatttttctccatcaaatcaactttacagatttcttaattaggcgctgatattaactgagcccttgcatgatttaaatctagcttttaatctcagctattctatgctgctatagtttttatgagagctgaccagcaaatgctttatgctttaatgtctctggaaaatcaccttaataatttttaaacgttttttggggggaatagaagtcccaagatgcaaatgaaggcattgaggtccggctattggaatttgtggtttagcacttgaaaaattatgtgccaaattgctttacagaagaaaatcagatcaaagttaagattctgtttaaactttgtcattatttctcagacgccctttttaaatgccttaaacgtgcctccattgaaatgtatatgaactttttctctcttcctttcaatatgttgttgctattcatttccttctctgatggcattgcccaaaggaaaagctctcacacatcaccactatggccaggatatggaaacagccaaaacaggtggtgcactgtgctaagaactcggcattgaattgatttaaacacagcatttgatacattctctaccttaataagaggcaattgcaggagacctcatttccttcgttgcatgaaagtcccagtcaaacttgagggtacagttcccctttccttcctcttcttctcagcccatccccgcaaagttcttcccagcaagcattaaatcgcagataatgtactctacctgctctggacactggatattgtaaagcatcggaacctttttatttgctttacagggttgaccattctcataaggtcattgactttcttaattagaagctactttggggctgagcgcaatggctcacgcttgtaatcccagcaccttaggaggccaaggtgggtggatcatgaggtcaggagttcaagaccagcctggccaagatggtgaaaccccctctctactaaaaatacaaaaattagctggttgtggtggcaggtccctgtaatcccagctactcgggaggctgagacttgaacccgggaggcaggggttgcagtgagccgagatggcaccactgcactccagcctgggtgacagagtgagactccacctcaaaaaaaaaaaaaaaagaagaagaagctactttgacaattctcctccaaactctttatgtgacaagtaaaggagaaaagactgggagaaatgaagtgacttgcccagggtcatgcagccatttcctgtgacttcgtggtctagccctctctccacctcctctctcagccatcataggaataacagttctcaaactggagttttagttaggcttcacaatcaacactaacttattacaaagggacgaatgggcccttgttttatgccaagtgccatgcccatcttcagagactcaacaatgaaccagaagcattttaattctgatccaatcctgacctgctaatggctcttcctcgctgaactgcttaacagaatcactcctggctgaacatcacacagagtgtgaatgtggagaggaaacagaactttcatctcaacacctcctcattttacaaaagagaacactgaggcccccagaggtcttaagagtgagttcatgttagaggtaggcctagaacccacagtgctgaccccccagtgaagctcttgtcacttgagtacattcatctaattcagaatgcatctatcatggggcccattctgtcacatttattatactaatgccctttgtcatctttcaggtaagtttgtttctccctttggtctgctttgaagctccattctaacttgagaattagttctttaaatgccaacatctacataagacattcacattaaaatctccaacagcaataggacgatggtccttgggacccagagtttaggcacctatgcgatggaactacaatgattggcagtgtgcccggcaatagcacacactcatacctctgacagactcggggcagatccgaggaagtggtatcataagctgtggtcaacagagatactatgacgaatgtttggactgtcctcatactaatgtaatgtttgcactcgccacagatatacttaaaatagtagctacagtttatatattttttcaatgatcttgtaattcaatcgtgttcgataatttcagctgaaactatagatggaaactggacccattaaagaaggagttagatcttctatttttttttttttttaatgtgatcttccagtaagcggcctctggatataactacagaaaattaacacaataagtaaggcattatagaacagctattaactgattacaataataaaaaccaaataggggccttaattctgcccctctgggaaagcaggacagataaaataaacaatagaaaaaaaaagcatggaataaaggataattgattttaaacaataacacagatacctcccattatgtttaaaaagatacagatctctgtcttcattttgggaacgataggggtaaattcttatttcccctcattaagacttaagtttgatactaataggggtgttttccaggctaacaaattggaaaaattaaggggtgctgacaaggaggttcttaaatgatgccaggcacatggctataatgactaaatttactgttttaccaaaattaggagcccttctggtctccctcagaggaagacagaatctaaacattcacagttcatgctccgtcagggtgggacaggaagtaggatccaataaactcagcagtcaaggcaaacaccaaccctgatagaggagagaagacagggtttccactaccttgggcagaggctggagagccctttaatggcacccccagtacagtaatgcctgttgactaaatcctaaacttctacagcatgtttggggttagttctatgtagaaattcatagtaaagtctttccatttgttatctaaaacatggcccatgttcctgccttcaaacctggccagaacctaacagcttctctcttttaagtgcctgcttaggtgccaagtgtccaactagatgctttccagaagttgtctctgattcttacattatcctagcaggggaaagatgctcaatttagagttgaaaaaatggaaactcagggtgacacagagatgtgtttgagatctcacggtttttaagctgtggctcatcccaaaggccacctctgcttggagaggttcaccattccacctctccacatgtaaccaaacactcttgctaaacattgctgtttttcccctcagtctattttcacatatcgttctaaccagtctaacccatggaatcaattctttttgcatggcacatgcaaattcccaggttagttttacttttccctggcagaaatccagcataattaaaatgaaatgaccatttctatgtgaggaaaaagtttagcatttcctaaaatggaaaaataaaaactcttacgcaagacactaacttttaaggtggcagaaaatagcgaggtagtttcttatgatttactgaataaatcaagggtgattccaatttttatggttttgggccaagaattgaaagagagttctcctgccgtgaaccatgggtgttatgactcaaaaagaagcatcactagataagtaatgaggctgtgtgtacagagatagaacattcttgtatacaaaaagggtaagatgtactcagcactgagcagggaggatggggagccatacactgggactagggtacagaaggttcaggaatggagaatgaaagttgaagccaaaaacacatctaagagccagagcttataaaaaatacagcgtattcctagcagtgaaatactgaaagtcttcctaatgaagaatctttttaaataatttggaagttctaatcctttgcaataagacaggaaaaataaagaaattacataaatttgggaaaggaacagaatgatcattatttgcagataataatgttatctacctagatgattcaagagaatcaaattgacaagttatttgaataagaaaccagtaaagtggcaaatatgaaataaaaatgcttaaaatgctgaaaaaaataatgttgctcagcgaagtcatgaaattgaatagggaaactgcatgcacaatagcactgaataaatgggagattgtattgagaaactacctgatggaactataactttatagaagttcatatgaaaagatcgatgagaaggcatggtttatttctacatgagaaaacctggttttaaaaagacctctaatccacacacattaatctataaattgtactctctctctttttttttttgaatcagaatctctctctgttgcccaggctgaagtgcagcggctatatcatggctcacggcagccttaaactcctagtctcaagtgatcctcccacctcagtcttccaaagacctgggattataggtgtaagccaccgtgcttggcttaaattgtattttctaacatctaaacttgaaacttgatgcattcctatggaataacaaataagaaagcatcatctagaataccaatcttaaagagggagagcttactttactagacataaaaccatattcttgaattacaataataaaaatggagaattttggcaaaaatgatggagacaaaaagataataaaataaacatggaaacacagaaacgggaccaatagcatacatttagatcaacaaggaaaagaaattttaatgaccaaaaaaaaattccagataaataagagatttaaatgtttttataaattaaaggagccacagaagcactagtagaaaatataggttaatactgattttactctgggcataggcaaagccttttaaaacataaagcagaaggaagaataaaggaaaatatttatgtacttaaattcaacaacatatccattaacaattaaaaaccaaatgacaaaatggagaaaatgtttgcaatatatgataatgagagagttgataaacttaatatgtaaagaacttttataatttaatagaaaattaatgaaaatttccttagaactacagggcaaatgttaaataaacaaatattttaaaaagcatgcaaaatcacctgcacacaaaacaagacagagtcaagaaatggaaagaaagttagcatcacaaataatcaacataatacaaaacacaatgggatgctatgtttcttatcttttggggggaaagggttaattatggttcctgaaatctgtgtttgttcacatgcaccctgagtgagaatataaatcggcaactttggagggcaactctacaaaatgtagccaaaagtaaaacaacaaaacagaaagaaggctttgatccatgattttcacatataataattcatccagaggaaatgaagatacacaggaagattttataagggcaaaaagttacaaatggtatcaatatctaactagaggttagaggaatgaatgagttacagcctctacagataaggaaatgcaatgctggcagagaaatcacgttttggaggctgggcacagtcgctcacacctgtaaacctgcactttgggatgctgaggtgggtggatctcttgagctcaggagttcgagaccagcccaggcaacatggcaaaaccccatctctacaaaacaaacaaacaaacaaaattagctaggtgtggtggcacaggcctgtagtcccagctacttaggggagctgaagtgggaagatcgcttgagcctgggaggttgcgactatagtgagcccagattgcaccactgcactccagcctgggtgacagagtgagaccctgtcccaagaaaaaaaaaaaaaaagaagaagaaagaaagaaagaaagaaattatgttttggaatagttttaacaaaatgaacaaatatttactatgacttatcaaatgggaaacgcagtttgcaaaatagtacactacagcagggcctgcactgtagtttccaaacacacaaatatatgtgtgcaaaaaaagtagaggaaaaagattagaaaatgtctatcaaagtgttcacaatgattatatttaagtggtgagatcagaggcaatttttatttacttcttcacgctttcctctaatttccaaatgtcttgcaatggccatgaatggtcactcttaaccactgtacctctttgcaactaaacaccaatattttcttgtgtttgtttcagtcctactttgccagaaatttgcaggtgtcaggtggactacctggagaagatgctacaggagaaagtgaacccggaccgccagtcttcttgagtttgtgagtctatgccttcaccttgttctggcttttttttcttttcttttttatctgttctcagaaagtctgcagcttccaacaccattttatttgctcctcctgtgagtgacagaccagtgtgtcccaagaatacttaatgtattttgtgtcaggggcctgtgggtcagtaaggttattaataaacatcgcctcttgttctaatttaggtccctcctctccttcatgcctctcctcctgccctgcttttcctttcgcttctctttctgtctgacccttttccccttctccctgatataaagcattcagccttcatttcagctcaacttctggcacttttcccgtgacgcttttttgatgttgggtggtgctgttatgttttcatggagaatttaatttcggaggaaatgcttactgtcctaaatcaattttatgcaggctgatatgatgctatgatctgacaggcatgggagggtgaaaggatcactaaaatcgaggcaaaatgtggatgaggagggagaacacctttttaaaaaagaatttctgtttgacaagattcactgactacaaaacaagcccagaacttgagaggccaggatcatcaaccctacataaaaagaagtgacgtttgaaggcagaaggcatatttgaattttggtattttttaattatctttaataggacaaaaagaatttaacaagtttatcatgtacatttggatatatgtatatcaattttatgttccattaagagtttgattgaccacctcaacttatatttagataagccttgttttatttgtgctgattttattacacaaatggaagtggctacattgccatcatcactaccaaattctcacacacacactcttcaaagtccccgaatattgtccaaatcctgttcaatttttcttttaacttctaacattttctaagtgcaacttcaaactggaggttgttttgtaaactgaaaaaaagtcaactccccagcagtacacacacattcacacacacaagtgcatgtggtcttttcaatttactaaacttcagttactttcttctaaaaaacacaatattgcatctcctatttgagctctatgggagttacacgtgccaatgggagtttacttaacaaggaggaggcaatatttttatataggaaaatatgtaaagagaaatgcataattttgtgttgaatgatttatacttttcaaattaatctattgaattttttcatattcaagaacacattattttttaaatatgacctagaccactgttttcagaatgagtggtatgaatggtgccatgttttaacacatgattaatttgacttcaaactagggtcctcatattgtgaactactttttttaaatgaagaaatgacaagaaagctaaatttattaaggaaaaagatagtttcctttttctaatttcattatcattaaatatactagttttatagcattaacagaattgcacctgatttttggtctttcccaaattgagaaagaaaatctatgggaactctgaatgaattaggcattcaacttcttaatggtcactcttaaccactgtaccttaacagccagagaggcaggatcctaaactcagctaaaatctccactggaaatagccacgaatcatacttgactgaatgtctaatttggttctttgtttattctttatttttccatttttctttcgattagatcattcctacctgttctataccaataatcaaagtgtgagcatagctttaaatgtgttctgtcaaatgcatagtcctttgttattcatggaataatagttacgtttcgttaaagatagtatttttcttaatattcataggctcgcataagcattattaggatatggtggggaagaaaagatgaaaaagaggaaggaagcttttagtgagtgcctactaactagcacacattgcaacagttgcaggtgttcactcactggtgcatgtatgttgcgctaagtgttctgatgttgtcctcacagcattactgtgaagttactgtcttaaccttagcatatagatgagaaaaatggggcttaacggcaacatacccaagatacacacttattgtggcacaaagcagggattcaaaccaaggctttgcttgccaaacgacggcacttcgatgattaggaacaggcttcattgtttatagctgtgagggccgggactccaaggagcaaagattaaatcctggtgtttgctgcaaccagagcttctaagctgatcacttagaagatatgatttggggatgtctgaggggccaaaaagaccttgcaaataatcacatgagataacatgctggaaatcactgtgaaaggtttaatatagcaatcatcatattcgcatgacaatatatatgggatacgttataacacccataacaaatgtgattcaacttggttgtaccagtgactttcaaaaggtgagcatctttgtgcctttgttttacgtatcttaaattttctatatttaaaggtcattggttccaagatgctcctttaaattttgataaataaatgttctgaagatcatctatggggaattcttccccctcacataataaggttggatgcgaagcgcagttttacgccctgtagcagacttttttttttaaatgcccgctctgttttagctgcttccaagtcccagcctgggatcggcaggttgtgggacaaggataaagagtgtggtgagtatcgggctacagttctcaatgctcgagggataagatttcttatgaaaactggcagcttttttgttcttcctcagcctttttaacacacagccaggtctctctgttcagctgtgcccgctgtggttgtgagtgtaccgggctaaatttatgccgctgacaacccccattgaagtgtctcagtggcacagagtcagtgggagttatgtgtatataagcaccagcagaccttggcccgctgagtgtaatagcatatctggcttgggagattatgggtatgatatgggccatgtgtaatggatagggcagtctgtgtacaaatttcaaatgacttgctacacccctttaggatggttgctgtcaaaagtattagcacgttacacacacaacaaccacatatcatattaccggtggcccctgctcctacagaatggctcctcccacctcttgcagtaggtaattgcttcaggggtacctactgaacacattcaaaggagaaaacactggtgaattttattctttgagctcgactgttttaatatagaaggaggaaaataccgactgtgtttaaattagcatggacagaagttcaaagggaatgacgtgtaaaagatatctctggcaagatttaaattttcaacctgatgagaactggctttaacatactgaagctgaagccaggggagggttacatggatatgcacctaaaaatcaagacctaccctgatggcaaaacttcacttgtgatggaaacagaaagctaggaggatgcagaaactttcacatcgtgaacggtgtctaaaacatttattttttaatcatatatttttttaatgcatctgcctcaggcctaggaatctacaaaagttgaaacaaaatgaagatctgattaggaaacactagcattccttggttaagctccttttcttgctaaaagtagacagtatcccctctcagactggtgtaagcacaaattaagcagaatgcattcttcttttctgagttgagagtagacttaagtgtgtgtcttttctggtcttccatgataaaagaggcatgatagattaggtcaataaagacactgatgctattatcgttcacagaaagattagtggcaaaatgaccaccaaggagatggtctgaggttgaatgtacacaacttctctttccatggtcaggacctcttttttataatcacgttgaaaatctgttagcattaggagccacagcatcgactgtagtatctgcttacatgcaggtctaaaacactgtggaaacccattcatcatattctcagtatattagcaccaaatgtattccaggcacagcattagtctctggagctacagatataaacaagacactaccctctccttagggatcttgtttcgatttattttatcttcattaataaatagtgcatgctatgtgccaggcattagtgtaagtgctttatatatcttaactcattcaatcatcaaaacaaccatacgtgatagttacattattatccccattttagagatgaggtcattgaggcacagataagttaatacacataaggccacacacctggtatattggcagatccagtacttgaaccctcgcaaatcttattccagagaccctgccattaaccactacttatgagttaactgaagaaataaacatgcaactattttcaacatattcactagtgacaccaaagaccccagaaactccagaagccctggcatctgcaatatttagttcaatgactgggcaaaaccgtaaaaaagaaaaaaaaatgctagtaaatttgtaaaggaacaaaatataaaggagacagattctaaaagctaccacaaagccaaaacaaaatgaaatttaatgaggataagtgtgagacgttcttaaatgcaataaatcccttgtacaagccccagatgattaagatttgactccaggatatggaggctcttccttcatgaaagactccatttaaagccaatcacatggcgcagtggacagacactgtccctgatggtcatgtaacttctgagtaatttacttgttttgggacacttcttaagagactggcagggccgggcgcggtggctcacgcctgtaatcccagcactttgggaggccgaggtgggcggatcacgaggtcaggagatcgagaccatggtgaaaccccgtctctagtaaaaatacaaaaaattagccgggcgtgatggcggacgcctgtagtcccagctacttgggaggctgagggaggagaatggcgtgaacccgggaggcggagcttgcaatgagccgagattgcgccactgcactccagcctgggcgacagagcgagactccgtctcaaaaaaaaaaaaaaagagactggcaaaccaaggccaactcagggaagcaaatctcttgagtctatgtcatatggggaactgtgaactttagccactgaaacaaaagcagtatattgaggggcctgaaagtcttcaaagatttaaaggtctatcatatggtaaagggatgagatttcattatattccttctgaagatagaatcagacaaaagagaaagatatttccaatacatcaatttttgctttcatacaaagaacaaagctttctaaaaacaaagttccccagtagtagcagccttggagagcatgagcccttcccctccatctctctagttggccctggccaaactggcagccttcacccagaccttctcacatttatgttaccttccttgactctgcaactcctgaaattcgctccatctgcatctgtttgatcatctgtccatctccagaactctgggttcagtgggaagttggaccaatgccctccaaacttccttccaagcataggattccatgacttcttgattccattatggagccttgaattccaaaaacttttaaaagcagattatctgttttatagatggaggaatgtcagagtgctgagtaaccagccagaatgagaggcaatgactccctctcacacctagattcctgttcacacttgagtaactgcttctacacaaccaaccttaacatcgttacagagcaacttactcctaaccttattctagaaaattgctctgctccccagtggccactagatcatttaggtgagagcttactatcatttctaagttaatttgtgagttaattgtaaatgtcaggaagctctgacattgcagaaaatggtaaattgttgagataaaccaggatccgaaaaatcctaaattgaataaagtttgttttttgaccagtttttatcagaaatatatgttgatttgtgaagggcctggaatggcatcatatttgagttgcctcagaagttagccctgcattaagtgcacacaggatgatgggataaaaagcgctttccaactccaagactcacacaatactccacaatcacagcctctgtcatctttttatctaaatggctatccaaccaacagagcttgaaaaagaacaactgaatctctgcctgtgcttacttccaattttctggtctaagatggtattcagtgtggttacgtttcttttgagacagggtctcaatctgtcacccaggcgggagtgcagtggtgcgatcacagctcattacagtcttgacctccccagcttaagccatcctcccacctcagcatcccaagtagctgggactataggtgtgagccaccacatctggctaattttttttttttaattttatgtagaggcagggtcttactatgttgcccagggtgatctccaactcctgggctcaagtgatcctctcgcctctccctcccaaagtattaggattagaggtgtgaaccaccactcccagccctggttacatttttttttttttaactctaaacacatccgcatagctatagctacaggtaaaatcatgacttgtcgtttcaatactgctgcattgggcagtcctgctcttcaggaatagatacctcctatttcttttccttgtcacttggttatttacctcctgtcaaggtcaagcccttaacatcaggattatgttaaaagaaagaccaatattttcaaaaacttctggaattatcagggttatgcaatggagactggtcttcctttgtagagggagaaacatgcatctccatcccaaatggttcaaatctctatcaacttcaacttttggagttttggctaaatgttctaaatgtctccttttagcccataatatctgtatttgccacaatcttatgtctgatcattctcagcagcacagttctcctggtaataacttcactgtctaccatttgtgactgattaatccacaatgtattgaaaattagagttaaattggaatgctatggtaattaagcacaagatggcagggagcctttattttctaacttcttttataaatatcatttttgaggagtggcaagttgaaaagctatatcctgacacagtcaattagactcttcctgaatgacaaaacccatgccttcatggcaggggatctgtgtgctaactgtgttacctagaagatgatattcagttccccatgcattgacattttagggaaggcaacgcagggctttcgctacatgtaggcttcctctatcctcagacacacaggtcagaagagaagtcaatgttaggctgaaattcctgtaaattacaatctccagtttgtggaccagagccaaagggctcttggctacaaagtgtaaacagatcattgctgcctcttaatctggataattggtcccaaatgctgttgccacttttcggatcgatggttttcatactttttaaagaatctggaacttttctccattggcagggaaaagtttgaagtataattcagtcttttcatcggcactaaggctcctataaacagctaagtgatttcatttgggggcctgcagacacaggaggcttgcggcctacttcgagagctccactccattttcccatgtccatcccacattcaagccaaccactatgtgtttacttaacatgcacagcttctgaaagagctgagcagactcggtcacctcttgaagatgtcggtcagatttcagaagcagggctatgtctgattccagcataatgtgctctcatcaaaacattccctaagggtgatgtgctgtaatgaatttggcctaaaatcagttgttttgtgacatcatctcctgagcaaaatcctggggacgtcatgcgagagaagacagcgtggtgttctgggaagagaccagccttgggaaggattcctagggataccgactgtctgaccctgggcccctcaaacctttgtttctctatctgtaaaacagagataatagtatataccttgtaaatttattatgaggattaaatgagatggtaaatataaaggttattacttttagggggacattccacacattattattatgtaaagcatttttaactatattttttaagcctatctttctgcttcaacctacacaaagaaaggaataaaatgttcttttcctgtgaaatccctggcttggacttcagcattccaagaaaatataacttacacagtgggtcttgcgagacaatgacaaaatctaacactgttctcttaatttatttttctcttagaccttcctctttgcctctttccaaccgccctagtgacgtttttaggccattgtttttcttctaaatacttctagaacactattgagttctctattaactattatttggccaacgttctacttgtccagttctttttatcttctcctctcaccctgtcattcttgtatttttttctttgaattccactcagtttatctctatctcttcagcactgaggcatcctacgtaatgtagttttccaagtggaagctcagcaaggacttacaggagatttgggaaaccaactcccttcctacttctgggataagaagattagacaagaatgagcttgtctactttggctttctccattaaatttactactgtcctcagtcattaaaaaatgggaaagcatgcctcccattcacagtctgcagcagtttgttttcaaacaacattgcgaatgcattttctctagagaggaggtatggcattgtacttaagtacagagattccagaaccagacatctggggctcaaatcacttttacaagcagtataaccttggaccagttacgtaacttccctatgcctagtagtctttctcatttgtgcaaaatgggagtgatagtatttgcctagtactttctatggtaaacgaaactgagttaatacgtgtaaaatgcttaaaacggggcctgattatcgtaagcactcaagaaatgtgagttaataatatttcatcctcattctgctttctagaaaaccctatgtatacttaacatccaaatgctgctaattttcccttttggacagtcttatgtggtcatctttccctatacatcattgaaaatgtgctttatatacttttcttccctaattcagaacattatgaaataaaacaagataaaacagcaattccaaaaacatcttctagtttactccatgcaacccatcatctatttatcatcagctaaagtgggatgaaagttttattatgaacccaaaatgcaaccgtagtttaccccaaagttagtaagtctgggttaggtttaagaaaacctggtttgaattttaggtgaacctcctttctactctcaaatgccaagagaagatttacagtttcaggtggacgccaaatgaaatttggtaagttcatctgtgttttactttgagtttgtcatttgaatgaactcaaatttcatacagcttaatcctcgtatttacagtttttctgccattttcacctcactggataaaaaaattaaataaaaattgagacatgctgttcagtatgtgagcaagttgcaacattacaggatgcatacattcctttgtctcaatcataaataattatggagaaaatatcatattattggtaaaatgtgcttcagtgagtcaaaccatttttggagaatattcttctttatctactatgatatttatttgccatgcaattccaaactgatcagaaaataattagcaaaattgtctgtttccatcaacgtttaaaaatctgcatttttatcagttttatccctgactcggttaaactgtgattttaaaatcaaatttgcataatctaagctttcttcatttttgcatttcatcccccacaagtcagaagcccagactttaagctagctaatttcctaaaattatatgctagaggtttgggaagatttaaggctagatattttatgtcaaaatgataggttcacagttcgtgattgatgatcttgtacatataaatgatatatgcccattagacacaggggccttctaggataaggagcttaagcaaaagtgagcttagagaaatttctacatcctaaatttgcagagacatgggcaatatgcttccagtttctgttttattataatgcaaaataatctgaaataacttacatatggacatgagtatatcgatgagctctgaaaagattattttgcctaaaactgcctgtttcactacagcagttaagtagaagctttgtagttacattacactaaatgcctactttttaatttaactaaacaaagttatatttggataaagttttttcctttagaaatgtatactatataaaattcccttcaaacaccactactatcttttcataagttaaccacattttataccattttaaaaattaaaacctggaaacataaaagtcattttttttcttcgaatttgtagtcccaaaaccactgctcataaaaataagctttacaacatctttgagaatccaaaagaaccccggtcaagatttttttggctagaaaagaaagcagttttgatattcaaaaatttggctgctcttagtcaatccccaaaagagaaaaatcagctaatcttagcaagatggtaaatttaagcgattctgtaatctaacgtagtcctaaatcatgttttaaaatatgatcaaacagtagagactgggaaaagacagaaactttaaaaataactcaaaatagaaaagttgaacatttctttaagaggcttttctgtttctaaattaaagcatgaatagtatctgaaaaatagcagcaaagtttgtgctggcatattccacttaatagcaacaacaaatttcacttaatgtgttctactactggaccatataaaacagtatgaaacatcagatttttgttggtcagatattctggatgtcatcctagagaacaagccagctatggactcagccatacacaggcactaacattcatggaacatatgactctgcacacacacacacacacacacacacacacacatatatacacgaaatctgaccaggctctgctctggatccttgataactctggcatattgtaagccctggaaagaattttaatctacatggtttgaaaataggggccttttaaatatgccgcatacgatttgtgatggtcatctctaaaatgcgcctccattatccttttccattttgaatgaatgaggctaattaatttcaggccatacttgatgaggtcagcaccatacgaggggtgcgtgctagacattgctaatctctttcagctgagagtgatgaattaaagatgaagcatgcctttgcaggcctaatttagaatgtatatcaaaaaacctacagcaaataatactataccctacaacaaaggaaaacttgttctctcaggctccctgagttgtgttgattttaaagacattttcagtcatctctggaattccagctgtggatgggtgaaccatatcaagaaaatcaagccatctctcacacatggccatgtggacaagaagtgggattaaaggaaagaaagaaaacaaaaacaaaatacaacaatctgggtttgatcacttgtgtattaaaattccacctacacattaggcttttttttcagagctaccagactaacaaagatcccaaattagcaatacctgtattcaagcaatgaccacccagctctgctgggacatttcacagcaatgtgctaaatggggcagccttgtttttaaagcagatatcctaatgaggcttattaggtttttccacgtctctattttgaaagccaatagagattgaccaggtagataatgtgataccttttattatgccaagaaagaaattgtaatacagatgcctcgaggccaaaatgttcttatgaaagttaatgctaagccagcttctgagttgggaaaagggaggtacttgctgatctgaactctgaagagaagaatgaattagtcataatttctcaaagatgactattacctattacaagtccctaagggtggcaaggaaggtggttttgcccagagactggggaacatagcttgcaaaaagtgttttcagcctatctagcaagagaaatcctgacagtttattctaatgcattggaatttccaactaactggtggcacaatggcttctgactttctatcccagtagccctcattagaacaaagctgcttcgaattaggtccaatctgcatgctgaatcaatctttcatccctttgattgcttctgaaaatatttatatttcttaataatgcacattttgtcttgcaacttctgattaaatccagacggaggttccaaaacaggcaagggatatgaaagggtgatttgggacaggaaaacaaaaattaaaaatacaggtttttcccattgggggaccattagagaatataaatctagcaatttgggtgatggaggcatcagaggagcattgtaataaatacagatcggagtgttattgtgacttaatggagatgacagaatattcttattattgtgtgattcttcatcgcagcctccactatgtaactggtgagtttaataggttttatgaaaaactattgtgagagagacctagaaaaatttcatattacagccaataataacccaataaaagtatcacatcataaaatagggaaatggttatgatagggacatgatcagataatctaaagtatcttttgttgagcaaggagcatagcgtaaggaagatgctttcaggaggtgaggattcctggtttgggggccaagagaaaggggtccagtttcaactgcatcaccaaccagctcaatgaccctaagtaagtcccctaacctttacagacctgttttgttttttttcttttacttggaaaataatggaggtaaggattttcttgcaagttttaaattctatggttttctaaagaaccatcgttgttttaagtattcagtgctctctggagtcaagaaaaagaaaaaggagacttcctctaatgctgagtgtcctcaagacagtctccaagaagcgggagccatgccctctcacagtgcactgtgtcacgcgcccctactcacctctgcataggtggctgttgcttctctgttcctcttttttcctcttgggcaccataagggagagaagcacacaagtgcaatgtccgtagatccatttgacccaaccgactcattttcgagatgaggaaagtaaagggcataaaggttgaggtcacctacttagtaactggtaaagctagaatttaagccaaggtctccttatttccagaccagtgcctattctgccatgacacactgctgcagagtctaaggaattttatattctgaaaagaagtggggtttcttgtgacccttcaatacaatttaagacttcttgtaattggaaacaggaacataggatagggcagcagctttgaattctgacttcctggattggaataatatgcctccaccttactaacaatgtgaatttcaggcaggtccttaaactctgttaagtctcatcctgtttggttttcattttttttctcttggataatagaaataatagcagtagttaccgcagagagctgtatagagattaaataaaataacataaataaatgcttaccatagttctggtatacagtaaatgttagctgctattagtatcatcatcctcctctttatttacataatgatgagtgaaaaaatcctgaaaggaacccaggagaaataggttcaaattctgactgtgctcctattggctccatgacctcagtttactcatcagcaaaatgggaatgcaaaatctcttcttgtacaggactttagtaaaaatcaaatgaatcatgcatatgaccacattttttaaacaggtagagccctataacaacacaattgttgatggttttatcaaaacataattatccctaggttggaaagcctctggatgctcagagttggttaataaataataaaatgagatcatgcccctgctttgcttctcaaataaatcaacttaaaaaagagatacctaaaataccattaaatcacaaaagaataaatgcatgtccccaagtatcactgccatctgttgaattcaattttactgttctctacttaaacttgcatttctctcagaatttgatcttaccggagcattagaggactattaggtcacagggtttagaacagtaaactcactctcttctttgccttccaactaagagagagaaagatctaaaagttaaaacacacacacacacacacacaaacattttatgaaatgttaaatgatgacctccaagaagccttcataccctctctgaaatactgccaacctttgcaattgaccagctgcttattgtgtataaacttaaaaatatattcattattgagatataattttgtttaagctaaagaagcatcaggggatggggaattgttttgtacatgggattattaaagaattggggcctaaaagtgtatgtctattttaaaaagaaattttctgattgcagataacttctcaatttgatttagtgtcgaacgatagtgatagggttgataagtgagcattcatcggtaattcatcttgtgctggtagaaatttacagcaaagcagtgctttcccaacagtgacaagccctattaatcttcttcagacacatttcaataggtgttcccatctgtggccaacatctaaacactctggcaacactggcgacttgaagacaccttcatttcaagttacactagtgaaaatgtgatactagattgtactctattttttaacctaattctctctcttcattcaattagcctttcttgcctggatttttctgctcatgtgtaacgtcatttcccagggagagcactcaaagatttggtttcttagagatgcacaatctcccccaaggttagcaaccaataactttttttacaaattaaaattgcatagattccagttctgacagtcattggcctctgatcctgcatgtccttagaaagtagaacctgttcgaataaagcccacctgtgcatcgagaaggctgaggaaaaggggaaggctatagaatccatttgtgttcatattcaaaatgcactttactattctgaactataatgtaaatttcagtgtgagggaatgctgggaaaaggagagacaattagaagagggtggtggaaaagaagcccgtaattcgaaatatgtttgcccaatatattcagtgcataggatgaaatgtctctcctgtccttttgcatccattggaggacctcctgttagagcgggaaattaaataatcactttagcaatagattatttcacttaaattggctttattctaccagcaacatgctctggctggctgcaagctcagactaggtaaaaaatgtggaggggttgtttgattttggattgcacctaagtgctttttctgtgacattttcaacctcataatgggtttggtcttgcaaaaaaattggatttgaacagcatttttcaagtgcactttagaaatctttcaaaagagaaaattctctgacacattcttattcaggaaaggttagatacatctgtataatggatggacttttttttaacttcactgaacatttttgtcatatgtgatctgaatatatatgtatatatatatatacacacacacacatatgttggggagagtgtgtacacatgcatgtgtgcccctatgtgttactggtttgtatgtgaatatacttacatataataatataagcattctcaaaaaatgtctcccttcttcccacaaactgtttttcacaatgatcatttgagtttgttgtagagctcagtaaccttattgtaggtggcaagtttaaatgtgccatattaataacttgttatccaagacaaattaagttcttatatgtcaaaagcactcggcactggattatctacaagacaagtatttattgaataaatgttgagtccaatttcattttaatgtgactgactgtatgtttcagcctcttaggcagagataaaaaacactcagacctataactgtgttgcaacattacacctaacttgtctatttctattattgtctcttaacttagaatatggaaagaaggcttttttttttttttttggttgttgttgttgttctgaagagcaaagagaaagatagaaaaacggctggcattcagcctaaagagaaatcattgaaacaaattaatcctatgctgtttaaattgacatggtaatccatcatcagagaaggcaaactctgaaagcaatctagaatctgccctgctctttcactggccctggaggcacaaagacagatagtaaaggaaggaggggggaaatcataaaagttagaaatgcctgagaaaagaataaaattggtggtatcagctctcactgtcctgcctctgcaaacctcctttggaaaggagaggttaactctcaacagttgctgtcccaactttccctctaagtggtaggtctctggagctgagctctagtctgcctccttctctaggctgccaggctgctcacctcagtctaaccattgcctgccgtgtttaaaaagttgaccagccaggagcttggcaggacccacagaaacagttcagtttgcacagaaactttcccaacatggtaaggggctccatttatggggtttaggatttgggtttctttttattttgttttgttgttgtttggggtcttttggtgggagagagtgagagggagactttttcttcattttttttccctcctatcttattttgtacttgacgaaaaagcatgttattgtaatttttaaaagaaaacttttgtaacgtccataaaaacttaggcaagacatcatgccctgtcacttgtctgtcttttattttggaggcttatttttcaaatctctctgcgcttcaaaaatcctgcaatgttaaaatttgcttttaaattcaaaaagtatataaaactgtaaaactgaagtgtcccatcttagaagatagttaaggttttaaaaataaaaaaattttaaaaacttattaagagctccactgttcaaacacactgaatcctaagaattgttttttctcttgagcttaatttatgtaatgtttatgtgttttgttttttaggggaggagacattttacagaacatacctttctcattattgcctggacataccaatttgaacacaaaagtgaatattattttttcaatttaataatgcattcgactataaaggcgagacaatttgaaaatatttttaacttcaaaaattcactctgttaacaatagacagtatgtgaagacaaaaacccaaatatctttgtaccaaaagcaaaaaggcagaaggatatgaatgtaaaccctacccaacaactgccctattttaatttatctaggatagtgtttcttctagtttattttaaaaaccttagcatgctactgaaacttcagaataaacatcacacctcttttctataattagaatttttattcactgattttaaaaagggagtgaataattcttgtatactgactaatgctttttaaaatacgtaagcataaaagacaaattaaaggcatttccagggtaaataggaaaggagggttaaagactcatattaaatattcattcatccacagccatgtcagttgcaattttaagagttgttaggaaagaagaacaggtttagttgtttgtttttaatagaacctggggggttgaaatagtagctcttcaataactgaacattcaaattgcaattcctgaaaaagatttgatacttttgaatttgttttcaatttatatacagtgtagactttagcaaaatagtatctaattttaaaagccattaaattaaccaaaatcacatgtaagaaaatcaatgagtaaataggcataagtctttatcactcagaggaggctaagaagaaaagtatctttaaaatcctcactacttaaatatcacaatagtagcatctttttaattacttggtaatgtggcaacaaagtatatgcaaagaaattgcaacatacctttagaagtaaataagttattaacatacattctacacagaaataggcttccccaattttgctatcttcttctccctgacggtgatgtgatgtggttctgccaagaaataaccaatgtgacatttttcactgaattcaatattcccttcctttaatgttctcagttttgctttaaactatttaaagtgacttcctctcaatccatttacctcagtcaagtacatagaaatctcctagataaggttgattaatttattatgaattataatagatggataggaaaagtatctttctctaccttgtattcaaactaaaaagaaaagtataaattttatttaaacaatacactttgtaaattctcaagctaatacatcctatggtcaagaagctgaatatgaagttaaacagtcttctcttaattttacacagaagttctttatttatttttaagatgcaccttcaacttttcaagaaatcagccttttaagaggagaaatgaggttgtaattaatttgtgcatgtttccctattatgacagtatgtctgtctctgtccacctacttactcctttatattgaaactgtcccccccccaaaaaaaaccttataaaaaccaatagaatggaaatcgctccttaaactatttttctccaactgcaattcaccttgagtttgtgttttaagaaaattaaattagatcccttttgttgttctgcttgtattttctttgagtactactgatgcagctaattaaccatattaatttatctgggtatttgccttactaacaccttcacatttaaatgactggcacttgatatcatttgattaatgcttttttttacataccaaaaattaactgtcatttaaaagatttcattaccagactcttgagaaagagaaaaatatagaaccagacaataattcctcactctgtccactactaagtatgagctgatgtccacatggctttagatgtctttggaactttctcagcaggatttgccttacaatataatattagcattaaaagcatgtatagcccacatcacacttggttaaatgggcagagagcccccttatgccatcatctctagctatagcctgttctcctttaattcttcaatccattgaaaagtaaaatagaatgagtagcatatccctgaatttttaaatatttaggcaaaagatgctcaccttttatttaaatgccttgccaaagctaccaaactgcaaaactgatggctttactttgaagtgtctttctgtgattttgcaagccacggtagctctaccatagctaagttgcttcagcttgtatttcaacaatggtggttctaaggagctcattcaaaactcttttttgtactgccttctgcctttttgccagtacacatgagtgacagcctctatctagtgcctgagtatatgaacctttaatccatcaaggaacttctaacaccatcagaatatacacacccacgtgcatacaccttcctgcagccaccaggtttgaaaccagcagaatatatttttctaatctcacccagattttatggctataatgtggctactgacaagattctaaaattagcttttatttaaataaaccatgtaatttttttttagttttttttttttttttttttagtttttaaaactctctgccacggcaatctactgctgtagacatggttagaaatattttttaaatggactagacggtcagttaaatacaagaaaatatttcactatattatattttcttattccctaaagtccatctccatggagtgtgctgcgggtgatggatgagactgttgtctatctgaatggaaacctgctttcataggaagggtggaggtgggagaggaccagtgaagggcagagctctaaaattctggcaactagagtgaatataccctttcctcctttcatccttcttcctttgctccctccctccctcgcttcctttttgctacgtctctttttggtagatcactgtagttaaccttcgttctggccaagaccaagaagggttaatggacacccggctcctgacaccttccaggtcagcttggcttgcgaacttccaacgcaggaattggaggattaccggggaaggaatgcgaggtacccgatagcctcacacctgaacacggtcgcttcaatccactgggattcatttaaaaaaaaaaaaaaaagaaattctcttctggaaaatggttaattggatctgcagctacatttcctgttgcaccgaagagccaagcagggcagcctggattggatccctcaagctgccaagaaaatcgagcaattggggggtggtggtggggggggggtgaacctttctaaataaataaacaaacgtaggtagctatcagttgctttagggagcgcagatatttaggaaaaggccaggagcgggaaaaggaagaagaaacgaaaaagattctccccttttcttaccttttgcccctcctttcccctcccgaaatttgcgcctacttgattatttgcagctgtttcgaacctcaaggtttgttcacagtagcgagagagacttgcgcttggagaagtgaaaagccattttcgcgccagggcttcgctgcttgagtttgggggttttgctctccctcccagcaaactcccctcaaagccttgctaacttcgtcaagccctgccagcctttactccttggccacttgggttcgcagtacccagccaagggccccgggcgggtttccatcgctgggggtggcctggtacccccaaagctgagttcccgcctaggagaggacgctgacgtcctggggcttcctcggtgcctgtcacccagccccctgccttcctcctcggcctcagatgtcgtcccacctgcccacgagcagggaacctggaacccactctcccggcagtccccagcgggttccgccacccggcggccgcccctgacaccgagtgggtgggaggaagaggcagctggcggggatgggccattgagacctcttgaaaaatattaaaagacaggatgggtagagatttctccgggagaaagttcgagggtgcatcgggtcgcggctgggaggagtacccgaaatgccagcaggagaaatgcaacctgtttaggccacaccttcaatccccgaggctgtctggagagactgcgtgcgggggacttgccggcgttcccacaccgcgcctgcaatccactcccgcggctgcctggcctctgccactcgcggcttgaagccagtggctctcaagccctcggccccgcggcggcccgcgcagccttcacccggcgccggcaccacgaagcctggccgcagtggactccccgcagctcgctgcgccctggcgtctcccgtcgaggagggagggacggaggcctgagccgggagctccctggcggtggtcgggccgccccccttgaggcctgctcccccctctcggcctcgccaaatccctgaaagcccagtcccccttcgtcaccccgggggcttctaatcactcggtatcgatttccctaactcttttcatcctgttgaagacacatcttaaaacactccagcccggagtgtgctctgggctttatccacactaataaaatgatttacccttctctccgcgctctcctcacagaggaaaatcgttcgagccccggctatttgtgtgtgatcagtaaatatttagtgcgctgacatccttagctgggcttcggatcgattcggggcccaccgggaggtgcgcacggtccgggcggggccgcgccgagctcgccgagggggctcctcccgccctcgccgccggccgctgatttacggcccctgcaaccagctaaggggggcgaaagcgcgcctggaaaattggcttttcaaccttttacttttgacattcagccacttccccaggctctaattctcgcccgcactcctccctcccgccctactaagggttgccctgtgcgccctgcgagcccttccagcagcaacgcgcggcgctcgcgccccctcggcccggggaccacctatcacagccctgagccgcgacgcggggaggccccggcccctgctatgggggtcgcctccttcgaggagagatgctctccgcccgcccacacctctgagggaggagagggggtggagaagcccagagctgcatctgctggatgacgagccgctctccctgctaccctttctccgacccgtcggcctttctcctactctggagactgatcctcgacgtccatcgggccggatggcgtcgggtggaagcgttactttcctcgcagaaaaactcctcctctttcctaagatcagaaaaagcgcttagcttggaattgttaggtggaggcctcctgccctgatagtggctgtgagagggctgcggccgtgacaccgtctgtgtcccctggccctcctggccttccccgggcgcagacgatttcattattgcagggccgcaccgtggacctggagtagggcactgcggggtcccgctgcgtcctacgggagcgctacctcggtctgctacgttgcccgagtaagatgtgaggaatcccgaccctcggactccactactcttgggccggggcttcgggcctgaaagtctccggcaatgtcgcccacctgttagcgagcttgttcccctctcacctggggcccgggcctttgcaattcccctggggcccaagaaggaaggggcatgaccttgctgggtctaggcacctctccaaaatgctagcgccctctcctttgtcctacacatgattttctaaacaaccttatctgcagactatatctttatactaatgcatacttaattggtccgtcttgactgtccatataaaacaatttaattagggtgctttcttgctttggagagcaaagaaaaaaaaaaaaaaaaccctgcccagtgcttattgtatttagcaccaatacaggcagaaaatgtagcacaagtttttggttgaaagagcacctctgtgcccattgaagggcgttgatccgaaaagacagaaaggacaagtaaaatcgatttgaagcgaccctctctgtccctttcacaccattcagaaactccattccttctaagacaaagaccagcgccttgggaattctcagggaaaaagaggactctagtcccacaagcctagggcacttttttaaaaaaaaatcctcaatatttcacttaaaacccacacttgatgctgtgccccccaagtatgggttccacagatgccccctccaaagtgccaagctgcaaggctgacaaaccccctttcccctgcctgtttggccttgtagccaggccaggacagccgtttagggttagtgcagccctcacctttgacctcctagatccgagtggctgccagcactacaactttggccaaagttaaaagaaaaccacaacaaaaaattttttctgctcccaaacccagggaaaccagttctggttcagccgcctgagccaccttacccaatagcaacctccatccctaacttttttttcttcttcttttgcaatgaactgcctgagccatctctgaaggagggaattgaagttgtcagggctccacggctgggttgtgggtgggggtgagtttcttggtctaactggtcctccattaggaacccccgaatgccaggttatcccactggtgcccgagctggggaaggcagtcatctatcagaactggcaggaaagggagaagggagaggaatgagatgggcagggaggggagagaaaaggccaggctgtgatcatcttcacctgccctgagtccagccttcctgttcaactattcctcgaccttcggctggggatgaagggggcgggggcgaaagggagggggcacccccgagttacacaagtggcctccttctactaagagaatgagttcacctcctccccagaggagcctcaccatccatccactcagtataactgatgagacaaaccgcaaggaaaaacttctgtagcccatatttatggtattaatgaatagttaaaaaagatttacacttcttatgatcaatattctgagttattttgctcaaagtatataattacagtgtcttcagagttttcatcattgtttgaggtggcaaaaccatttgtaattttcattagccagtaaacatgtaattaacattcagcactgtgtttaacttaattcctgtttaagacaaggacaagaagcagccgaagagcgttagttccatttgtcaagtctgacatacatcttaccataacagtttcctaaaataaaagatccgtgtttccccattattcttctcttaaaacaaaacaaaacaaaaatccattagttaagacagtattaaactgtgagaggcagcatagtttatattcaattttcactagttaccgtattcttgcttcctttattcgttttggggagtagagaaagggagggggtgaatgaagcattcattatctgaaggcatggaatggggaacccctccccccaaaagaaatagatttcctcctcaggaaagttctagaataaggaccggaaaggggggaggcagaaatccacaggggagagggggaaaaatcacttggggagacttgagttaaaagtagaaaatgaggattccaaaggattcctaggaaaaatgttgccctcttgtctcaagttctatctttgatccaggacgagggaagcctgtctgccagtctgcgaggctgatgctttttccccctcctcttccacctctgttttttcccaacttgctttaggattagcctccatctctctcgaccccaaacagtggaatttggctgtgccttgggtcgtcttgctttgcaatatcgcctatagttgttggcggttttctgctgaggctgagccgtttgctccagcctccgactaaactcattaagttgggagatttttttcaattggacgggtgtttttaaagtctcgtctttccagccccaaacaaggtgtaacaacgcactcttccttctaaggaatgagatgagagacaaggatcactccagacatctcctacctacggtttggggttttttttcttaaaggcgaggcttgcattcctcagcagctatgtacaaagctccctgaaaccttgtctctctaaagttagtgtgcagggttttccaaggctgagagagcctaatacatggggaagcacttccttgaggtggaagatctctcccttcacctttcctctttttccctgcaggctagtgcctactttttatcagtttgcacaatcgcttagataaacaccgaggaggagattctctttaattatcaaagacacatcttttcagggggccaacaaagcatttatttcacccgccaaactaaaggagagttattccagtttaggaggaagatgcaagcggtttgggaccttgaacaaggcaaatatggttttggtatgtttacttacagtattttttctctctctctttcctttctcacttttctgcttgtgctgtgtggggttggggatgacttggggcttttcaaaatatcggtttgctaacgtgtatgaaatgccgaggactgtggtttaaggggttcggggaaggggggatcagagtcaattcaatgcattgccatattttattacatgtgtgtggtaggagagatggtggagggggaggggggaaaatacaattgcaaagctgccaaaatatgattaaaccgaagcgttaagactgcggagcctcctatctcctcgtcctgtctcctcaaactcatttccttccacagagcaaactaaaaaccagtcctataaagcgtggttttgcaagcagcagatgactcggttttctagcaaaggagctgctaggctcgcactaagtatcagaatttactgttcgctttgcctctgcgcttcattttgcaaccttgtgcaactgacagccaggcaggcagggagggagaaaagcctagcccggcgccctcggccacggttcgggtaggcgagcgctcggttaagctaggaggagaatcgcgacgagaagggtactcaccatcgggcggggcggtggagctggcgtgcggatttcaggcaaacgtttacctttttgctgtctattgcaaccgcgccgggctgacttaagaagcaattctgtgctctgtccagaacattcaaggagcggttcctcatttttaaaaagccagcgagagagacgacagagacagagagaaagaaaaagagaggagggggtgagggggacgcacataaacccagttcaaaaaaaaaaaaaaatcacctcttcgccagtgactcgggaaacgcagaggtggcgagatccgagtacggtccaaccaagccagagccaattaattttaaatcctgaagaattattcagattaaaatgtacagaagtttcgttctcctatgcctacgtgagtccaaagtcgtttccctttaagagctccttttcttttaaagttgaattttaggcagcgaggactcttacactagggggcagacagatactgtacttgctctaatcttaagcaattttttccctcccagcatatgctctgatttagcactgtaaatttttcagaggacctaactctgacagcccctggtgattttcaaagtaccacaagccagtggttaaaaattgcattgacttggaagttcagagggacacaatggaagcccctttccctattcatggagctccagtgtggtggaagagaaaaacacacacggactagattgagggaaaggaggaattcaatgaatcctggaggacggaactggtttctactgagttcagagttaaactcggcatttgctggggtctgtattcatattgtgattcaatctgtaaagaaatacagcccatcaggccactttctgcaagaaaattatattcctgggtgttgagtttctttcttttcttttttagattagggcaaatgttgtcccaactttctctaggcaaattaaagcttgccattcttctcattataataaatttacatctgcaaaaaaagactgagttggatttttaaaaaacaacaataatatattgattttatcttctcagagctttttaaccttagacgcacagcaagtgagcatctctggagaagacatttaaaaatatttttgcccttttttcttctcagtctgtagtcttgtctcttcttctatgcattaaaattaagtataattcatacggtgattttttttctcccttgtaacagcatttcataactgaatgagtcctaaaatacagagtgaaacacccctgactttatggcagccctgtgatcatttgcctagcaggctccaatttgttaagatatggttgggaaattattccattttaatctaaggccatcacgcatacttcaaattccaaaaatctctaagtggactggggaagctcttcctcctcgatattgttccttcccatgtttgtaaaaggtaatctgctatggaagtctcattcaggaggtgagatgaagatttccctataatcaattattttcatcctctattgagatgggaatgcccattagatttcctatctcaaccccagtctcatcacatctcagctgagcttgtcccgaatctgctgacatttgtaacattagcaattcctgaatcatagaggttggaagggaaaacaacaacaactaccaaaaaccttctcctgtgtaatgatttcttttccatccttcttatcctctttaggagaaagttatattgtgtctctaattaacctgaaattctcagcttggcttcattctgtggcaatcttattacacaccaggtttatgatagttcagtgtccactataggtttgctgggcttttttttttttttttaacaactttcaaataaaccgagaacctgcagctttagtgaaatacgtgatttcatcggagaaagagtgagggctgaggtttcgggaatgaagcttaaagaagatttttcctttcctaaaaaccagcccctatctgcccagatctttagtccttacctcatattctgcctatgtgtgtaaagagaattgaatgtaaaatgtgatctatgcatgtcaattatatgtatggtttatttttaaaatatctttaccctgtcaatttttttttcagctaccaaggatgttttctgtggtcatcaatttactcttcatatgtgttcatttctttcctggagctcagcgtcttttgtgtaaaatattttaattgttcacaaacctggttggtttaccggcatgaggttttttcttggtgcaaagtgtgtacaaaggagacacaattttcttgtataaatgtggaataatgataattcactaactggtcataaacaacaagtttactgcgttggaatatagtgtgttctgagagcaattctacatgtttgatgtttaaaaccagacaccctggaattcaaagacacaactgtctcaattattttagcacatggagcagaatggcaataggctatgaagttgttctttttgcagtgacttcttgaggtagaatatggcttgggtttggttcttgtgacctgtactagtattatttcccatttggggcagaatctctgggtgcgttttaatgactatatgaatgcttaaaaggaacttgaggaacaatgaagtccgtactcaactgttctatgacctagaagcatagtcggtgaagtctttgtctgtgtacattgacaaatgtgcatctgatacatgtgcgcttacatgtgtgtacagagggtgtgcacaggggaggctgggcggctgcctcctcctgtccatcagtgggcagaggtctttcccctctcaccatgactgggtgtgtggcaggatgttggctggagagttagctaaaaccagcgagagagggtaaagttgaggaaaattgattctaattgcatcatgacaatcagatgaagtctatttctgcttctcagcatccgagatgctttatttgggcaattaaaatgtcaggccacatacctgtgaaatgttaaccctacaaggaataaacagaaacagaacggcctttatcctctgaaaagaatatatgtcatatatatatgtcaccaaaccgaacaagtgatcagagttaattaagagaagggtttgccatcacccggatctggccaactctttcgtttggaaaatgcctacaagctcagttcgtggcaccttcccaccctcactccctatccctctgcaaagaaaccagggaacttttctttggcattgtgggtactaagatgcgccaggagtcccgggtggtgcgcgagcggcggaattcgtgacatcgccaagttgcgagaggcaaactccccgattccatccaaagcctctcgcggagcctttaagagacgttgtgtgtgcgcgctgcgctagtctccccgccggggcggaaacctcgggtgcgggatgtggggagagcagaggcagcgctcgcagggccagcacgggcccatccccctctcggcggcggcggcggcggcggcgcggccaccccgtccccgcccccccaacccccggtcccccgcgtgccccgcgccgcgccggcgacgccgctcgcgctaggaccgggctgcgcccgcggccgccatggcggggccgccgcagtccggccaatgacggcgagggggcggcgcgcgcgcgcctggccaggccaaccccggctgctgccttataaggcgcgccgtcgccatggcaacgtgcgctaagttgcagcagtcgtgtcaaagttcactatatagagagctcagtgagctgatcgcggagaagccacttctgccagccccggcgcctataaatcgcattccctcccgcgcccccctttttagcatatttgatcactttgattctctgttcttttctctccgcggtgtgtgtgtgcgtgcgcgcgtgtgtgttttcttcttctcctcctcctctccccgagttgcctcctttctccgggtgccgtactgccttttttcccctctttcattctttctctccgtctttttctcccccctctgcgcacgaaggatgtgcttctaggtggtgatctgccctcctctctctcttttatcatttctcccccgccgccggcgagttgactctttccctatgtgtgtgaggcggcggcggcagcagcagcagcagcggctccggcggcggcagcagcggcagcagcgacttcagcggcggcggcggcgctagacgcagcggctccgggcccgacccggcggcttcggcggcggctccggcggcagcggcggcccgggcggcccgcagggaacggcgagcggcctccacccagcgactgcgggcggcggcggccggagagagcgaggcgcgcgccggacgcccggggcaggcggcggcggcggcggcccagcgccaggacgacgccgcgcagcgcccgacgcggaccactttcatgctgattcccccggacccgggcagcgctccggccactccgcgggccgccggcctccgccccggcctgcctggctccctgggcgcgcccgcacccggcgcctccgatctcctagtcctcctgatttcgatggctttcctgaatggctgactgtgggctgccctggacttggcccccggacagtcgcctctcctcctcctctacctcctccttcaccaccacctcctcttcctcctcctcctcctcctcctcctccgccaactcctcggctgcacaccagctctaagagcgagagtgaacgagagagggagggagagagtgagagcgagcgagatctttggagagatttttttttttgcctcctacttctgtcttgaagccagacaatcgacttcagctctccctcccctccctctttctccacgttctgctcccactcgctctcctgtccccttcccctcccctcccggcggaaagccccccgaaaccaacaaagctgagccgagagaaacaaacaaaacaaacacaccgggccagacaagccatcgacaaaactttgcaaaagcaaaaacaaaaaaggaaaaactaaccaacctcaaccaaccagcccccgagccacccggggcgccctcccgcgccctcttgcaccctcgcacacacaaaaggcggcgcgccggagcccgagacccggggagccgccgccgccccgccgccgcccgcagccaggggagcaggaagtccggacgcagcccccatagatatggcaatggtagtcagcacgtggcgcgacccccaggacgaggtgcccggctcacagggcagccaggcctcgcaggcgccgcccgtgcccggcccgccgcccggcgccccgcacacgccacagacgcccggccaagggggcccagccagcacgccagcccagacggcggccggtggccagggcggccctggcggcccgggtagcgacaagcagcagcagcagcaacacatcgagtgcgtggtgtgcggagacaagtcgagcggcaagcactacggccagttcacgtgcgagggctgcaagagcttcttcaagcgcagcgtgcggaggaacctgagctacacgtgccgcgccaaccggaactgtcccatcgaccagcaccatcgcaaccagtgccagtactgccgcctcaaaaagtgcctcaaagtgggcatgagacgggaaggtatcggcctctcatttctccttccctcgtcctgggtcccggggtcctgggtacgtttggctagcctgctctgggtaaggacaagaagccccaagctcttctcttcgtattgcagcggaaaagggttttatactagaagcgagttctgcattggaacccagaccccaaatccgcatgctttggccgactgatttccttctttactctctctttgggctgtttccatttcctttgcattgattgtgagttcactggagtctgcctttctgcaagggatggggtgtttgttgttgttgttttaaagcctagtttacttctctctctctgcccttgtttttcctgcatgttcaacatgtccctccccctcacccctttccccagcccccaccctctcaaaaaaaaaaaaaaaaaaacctgagattgtacttttgtacaggaggttcaaattacaaatggcaattttatgcacttcgccgtattaacgctgccgcccgggcagcgctcatgtgaccctccgtggattaacatcctgctaaaaaaaaaaatacctctgctttcttttttcctttcactttttgaaacgaagagagcgcgataggaagtaggaaagggtgggcgaggggccctgggcggctgctttcgctctgcgcgagttgggtctttgtgatataaaattcgccgagcgccgcgagccgtgctttgccaatggcgcgctcggcgcggggcgcgggctccgggttggggcgagccaacgccggggtttctttgtgtttctgcgagagcgactctcccggtccggagtcagataacagcctgggcccgagcctcgccggctttccccggcccttacaggccctgcccaggctccgctagtgccggccgcctgctccctgcctctcccggcttcctctctctttagccggcctctctctctccgccctctccctccgtctctttctccgagcacactgattagacagacgccagacctccgctctctgcttgtctctcactgggggggttccccgccgggctggggctggggcttcggggtttgtgggagagtcgttccggagtggccacaggccgtctggggtggaccctcgtgccttttgcaaaagcgcctcaccctccccccagactcgcccctcccgctccctctcctccaatcaataagaaatatcagctgtttagcagtaaagaagaaagatgccctcagaatgctacatcccgcccacagcgccggggaccccgaggcaaggtggccaattctgggtcctcggcggaccagccccgagcgggcctcggaggcaagtgtgcccctctggccctcagagctcgcctgggtggtggtttgaaaggaatggtgccaagagcctggcgactccagctctgtggcaggcctgcctggttcttgcgctgctcagggcctgggtcaggtgggggtcgggctggggcagaccccgccggggaacctggggactgaggctggtcattaactgtggagtgtctcctttcctccccgcagcggtgcagaggggcaggatgccgccgacccagccgacccacgggcagttcgcgctgaccaacggggatcccctcaactgccactcgtacctgtccggatatatttccctgctgttgcgcgcggagccctatcccacgtcgcgcttcggcagccaatgcatgcagcccaacaacatcatgggtatcgagaacatttgcgaactggccgcgaggatgctcttcagcgccgtcgagtgggcccggaacatccccttcttccccgacctgcagatcacggaccaggtggccctgcttcgcctcacctggagcgagctgtttgtgttgaatgcggcgcagtgctccatgcccctccacgtcgccccgctcctggccgccgccggcctgcatgcttcgcccatgtccgccgaccgggtggtcgcctttatggaccacatacggatcttccaagagcaagtggagaagctcaaggcgctgcacgttgactcagccgagtacagctgcctcaaggccatagtcctgttcacctcaggtaggaaggagccctgtcttctcgtgcccacgggctcctagcccagagctggggcccagagaacttgggagtccccagggcaaacccagtctgctccttgaaaggccaaactgttgagtgcaacttaaagtgggaactttttatagctgctgggcactaccaggcctgtcctggggagaggagaggaaggctggattgcaggaaggatgcttcagatagattccccacatgggccatagggcagcctctgctgcctgtttcccccacctgcagtatccagattgggatgccctctcctgctccctttcctgagcccaggccccccgggcctgctgggccccagggaatctcctcaagccctcggttttctctagcgccctggctgggcctccaggagatgccctgggcagtggagcagccctgacattgtctctgcagggaaaagtttgcctgctaactcaataggagttggagctccaggcaaatccaacctgagggcagcaattttcaaaatcatattcttactggaataatgcagactgccaggagaggcgaaaagatgtgtcaggatggggcaacaggaggaaagggaccgtcataactcttcagaatgtctgcaggaggttgaagactctggcctcttgcttcccctgcccaagcaaacacttaaggcaattttcaaacaacccaaagtgtatgccaacttgggctggatatggatgttgctagagatataaaaccatcattgactgcattatgcaatctaattagtttgcatgtagtttaacctgtgtgagtaatagagctgatactaattaacttgaggcaaaatgatttttgaaggtgtctggctttccattttgggccacacctgagctttttggctgcctccaggctgagttcagcatagcccaggtggatggaaatcaccaaccccctttcacattcttgtactaagttgtcagctgatccttttgtcatggctgagaggggaaaggggttcccgattaagaataacaaacatctggacgttagcagggcttggaacctagtcacccactacaattttttaagcttgttaacaggaaacgaggagagatgtgtagtttatgtggcaaacataaaggaggtccacaatctcttccttattgttcgaaagaagtctggggaactaagtcattagctgaacagcttgcagcttcttagtcctcaaactgctgtcttgtacattgctgctttccacataaaacctcccagcacagccaccccaaattctgcctttggaagtccttaggtaatcaattaaaggccagtgtctgggcagggaagctgtttgcagaggtttggatagggattatttttctcgagtgcccctcatacctagaacgtttgcctgctgcagatatacagacaagatatctccctacctcatagccaccttcacccctgtcccacaacccaacacccagcccaccttcttggacgatggaggtagtcgttaatttcttggtatcattgctagctcttagccttacccttggtctttcaaggaaaaaaaaatgcctgatactgtcgttaacagtttaatttatgactatttgcaaaatgtggaggcctgtgtggagaatgcaaatcgcctcacaaagagataaaggttcctgttatctgattcagagggagacacacagttccgaggatgccgagggaaggagtcctgtgcaaacagatcttttagttcctgtccacagacacctctacattctgtagacatgcagagtcctagatatacatatgaggaggttgcatgtgtgttctggttcttggggtggaggtggtggtggagattttcgaatatctgttttaatgactcacaatatgcatatgttaaccccagtcttgtatggggagccctgaaaggtcaggtcacaacctgaaccgcctttaccaagaagcttctcatttcaaaggcacttactgtattttcacgtatcaaaaaagaaaagtgttttcctgaagataacagggaggggggatgcttctcggagggacctgggttttaaaaaataaaggggggtaggagaaaaagggagagagaagaaaaagggggaaaagaaacagctcaaatgaacagagagatcacggtttgcatggctgcccttcaataggctaaactgacaagatcagttttaaagggccacttaaatcagtttcaaagactggagaaaaatgagtcgccctctttggggggaatctgaggctggatcgtggacgccattactcgggactgggccaggttgtccacccccaacccccaacccctatataattataagccaaactattatttacagaggaggaggggagagagtgctggtagttttggtttcttctgtttactgacttgggccagacagacccaatgcacttttgcttgggcctctcaatgacccaggctaaggactcgggcagtgaaagcctgtagcacactgagctatgttttattttaaagcaaacacttcctcaggaccatctcttgctctttcttcccccaccccgcctcccccccttaagttttcagtacatagacatttgctccaactccggttggggcagtttgacagagctctgtgcacacacctcatgtgacccaattcaaacctcttaatctgatgactgaattcttcttcttcttcttcttcttctttttcttcttcttcttcttctgtttttaaactttcttccagatgcctgtggtctctctgatgtagcccatgtggaaagcttgcaggaaaagtctcagtgtgctttggaagaatacgttaggagccagtaccccaaccagccgacgagattcggaaagcttttgcttcgcctcccttccctccgcaccgtctcctcctcagtcatagagcaattgtttttcgtccgtttggtaggtaaaacccccatcgaaaccctcatccgggatatgttactgtccggcagcagttttaactggccgtatatggcaattcaataaataaataaaataagaagggggagtgaaacagagaaagaaaaggcaaaagactggtttgtttgcttaatttccttctgttaagaaaggatataaaaggatgttacaagtttgctaaaagaagagaggggaagaatttaatggactgtgaatttcaaaaaaaaaaaaaaagactgtcaaatgaacttttacagaatgcattaaaaaaaaaaaaaaactcctgtgtcggtcagaacaacttgctacttatcatttttgtataaaaaggaaattagtctttttctttttttggtaaatttttgaaaaatattgctaaaagtgcatttaaggagattgggagacaattagcagaatggagaaagtaagtcttttttttttccaaattattaattgtcctgtgtctatgtacctctagctgttcttttttgtacttttctggttccaaaccagtttattctgtggttctataataagttttgatataatcttggcttcttaaaaactgtgtatcattaaaatatatgttctgcaagaattaaaactgagtccatgaaaataccataggaagacataaaactttaaaaggcaactcaaagatgatggaaacgcacttacaagtggtgaccaaaatttttaggtgaagtcgagcactctaattagagaactggaggaaccacatataacacttaacttcccctaccctgcccctccccaaaagaaaccatgacaaacctagcttttaaaaaatattttaagaaagagaatgaactgtggaatttattggcagccaaggaatgtgtccaagacacatgctgaggttttgaataaaaagtgaacttttgtaatttgaattgggtcccgcttagttcttgaattgttatgaaaatcctatatctgtttgtatatttgcaaaccctttgtattataattgttgatattttccctttttaaaaaataccattgaaatcagcatgacaaaaataacactgttggcacttataggtaacgtgattgattcagtatcttagagtttacagtttgtgttttaaaaaaactgaaggttttttttttaagtgcaacatttctgtatactgtaaaagttataataactgaactgtttggtcgagtctttgtgtgttatattccaaggaaaattgaaagtattcagaaattaaaatattatttgatatctgaaacctggctgtccccactcactgtctttacatctagaagagcccctgtgagctctcgcttagctggccgggcggggggtggtgggggggggcatttgtttactcccctcagtcagtttgttcaaaggtggactactgtatttgcctgtttaatttgggtgtgtgtgtgttggggggggagctgaagttaatggtttatctatggtttaggaagtgccatactgatatagtaaaccacccccattcacctaatcctccttttaattaaaaatggattttccaggaaaaaaaaaaaggcccttatatttgtcacacttaagtgcctgcttagggaaggtattgtgaaaaagtattagaaatcttgagatcagtatctattttatgatcagaaaaaaatactcttttgtacatttctgacagttactcagaagatcgttcaagcaagctaatcacagcattgtaactagaggacagttgtttgcagtgagtttttccttaagtaggtacgattttttaaaatattctgtgattctactctagcgtggttgttgagagagtttcaaattcagtgatacaggttctaagactgaaaggtctacttttaatgtatatatgataacttgcagttggtttccctctcccctccccccctttaccttcagtctgtgagagcatgaccacagggtcaagggaatcttttccattggagttatgtacataaaaacacatcgacattttgacatttcagattgtgtggctacaatctgtactgctcttgggatcctttgtccttagaagccaaattaaggaagagaaagcaggacagagaaaaagaaagaaggaaggagggaaactttacagggtgtgctgatttggaagtagtaactatttcttttggagtctttttttcatttttcctctttctcttttcctggtttggaggaagctcggtgctgggagcttgcaattttgttcttattcaaggtttccaacccacccccccaccgccagtacttcatcatgttgtggtttaattctaattggtgggggggggggaggactagtgagggaggtgaaagaacagggataattttgtaaagtgtattaaacgttaatattcagatccagtcaatacatgcagaccagtaaaatctgatttgtgcagagttctccatctgactctcacttatttctgtagatatatacatatataaatacaagtatgttcttacggcacagtattgctgacctttagttcgaggttttgtcggttgttgttgattttcttcctcttgcaagtgctatccatgtgagtgtgtgaagtttctctaataagtaaaacacaggcccttttccttgtttgttttgtgttagtttattgtaaacagccatttgttgtaaattattattggcattaaattataatttatgattttcaaagcaaaagacaatccctgttttattatgctttaagcatgtgttctagacgttggaaatctctctcgcactcttaagtttaagcaatgagcttggggtctgcgaggcagaaaaacaggacccaaaatttttcaaccggttaaaacaaacccccttgtatatgtttagagtggccggaggaggatctgtttagagtcttgagttcggtttaagtttattgcatttaaagaaagtttttcttttcacgctgagttagaacaaaagatctttgctgcgactgaattggacaaaagacgagggctgggacccagcgagcgcgttctgtgtgaaattgacgagatctttaaaaaagctgctaaacatggcgactctttccctttaagtgtctctttttccttgctgggtttttttttttttttttttttcatctgatctgagctcgctttatttcttttcccaaccccgctccccctcctcctcgtggcgctcgggggtgtgagagaacccagttagacgcgaaatgcaacaatagtgcaaggagagagaggggcgctcgctgcttctcgccactttcaaacaaacctgggggaagattgagcccgggggggattccagcctgctcgctcggctcgcggtcgccctgcctcggcctttcaccattagctctccctgggccgcgaggagctggggctcaaagttagcgggcgacgtccgaggcttagcctctagccggctgcagggacgggggcctggagttggcagctgctacgggaaagtgcctgccccccagcccccgcccccacttacgtgcggcagaattccgccagcgccccgggaaagtccggggtgccgggcgcgcggagctgcactcctgggatgtgcattaagcggcgacaggcggggggggcgagggcgggggcggggggcggtcagggggagctcgagcgtgtgaaactctgcctcgaatctcgcttttgacttggtcctatgagctgagccaacatggcgtctcccactgcaccgcgagcgccgggctgccaggctcggcagggccgggtaatagaaaacacattggttaccaaaaagaaaaaaaggagggcggggggcgctaaaggccattccgtctgcaggcagaaaacccttttttaaactcttgctggcaagtgagtccggtcctcggttctttaattaaagcaacagaattcgtaaggaaaatattggtaacgctgtaccttctcccctccccctcccatattcaggagagttgatttcctgtcccctctccttccaagaaccaaattagaaaaataaaaagtctgtatccgcaaatgatcttaaatgtttgaatggtatagggggatgggaagaggacggtctttacagacctcggtcagttctcgcgctcattaatgcaggggctgcgccggggtttgcgcgggcccgagcggagctggggcgcggtggggagggcggaatgcgaaccccgctggacttgggcagaacttgctgcttttgcacgcccaagttgtgggaaaggaggctttccgggcggagggttgattggggggtgggagggtctagcaggggctgagggccggttccaggcgggtggtcgcagaccctagaaatgtgtgagcccgcgtggactgtgcccctggcaggagagcgactgcagcggaggaccctctttctctaataggtttgagagtgggcaagggcggccgtgggacagacctggcctcctagagagggtcttctgagggcctctgcagagatagtggatccgggcccaggctcccttctcgggcggatgggatatcgccccgccacgtccagctccatccccagccccggcctggacaaccctctccctcagccgcctgggatactctctgaattccaggcctcgtcaagatttattgaagttgggcttaaaaaacgtgcttcagatgatttttcccattttctcagatttcaaaggctccctgcagtgcggctgcctaattaatggtgaaattcaactaaatctaattatgcagtaattttaaagcagttagtgctgggcgttggtttgtaataggacctcagttttttaaagtttgcttactgtgttggtttaggggaaagctattttttgtatggtaaagaaagaccgggaagtagtactactggaggaaccagagggctaagaaccgctccccaccccacctctatctccatccccaattctatctcgttttccttctgttttttctatcccaagcacacggtaaaaagctgagcaaggtgctaacccaacaaggagaccctatttcatagccaaaggggaaagagagaatctttcatacagagacacaaagggcttggtatctgtcctggaggcctctgtaaatgcccccaaacccgggaagggattctcatctcctctaatagagaacagatttcctcctcttaacatccattgtcattaaggcgcaaagctgactcttggagttgtaaatcttatcgtccttctgataacacacttgtaataagttagcgtcctattcaaagtgaattgtaaaactgcctcatttaatatggcatctgtgtcattaaaacttttatttttctccccctcgtgtcttgcaggtttggccttggggctagcgctgaagtctctgcctatggggcctctggggtagggctgaggggaagaaaggtgtgaaagacgggctgcctggattcagcctctggatcttagaccggggtgagagacccgaggcagaatgggcctggggggtggtgtccctctatcccatctcccccggagcggccccctcgaaatgacgttccttgaaagaaacatgcttgtgattagctaagcaaacacatctgctttcggagttgggccttcgttaattagctgaacaaagggccgttttgctttttaccttttgctggggagagtgtgttatttcaggagtgttgcgggccctcctcttttcaattgcagccacgacgttaattttattgggattactgatgggaaatgaggtggcgcaggcttccgagaggaaaagcttgatcattaccccctttggaactatatttttccacccaacctcctgcttgagaggagggggtggggggcgaactgcgctgcaagttcggagcaattggaatcaggctcgcggtgcgctgatctcgggtgacagagcgtgtgttgaagctgaactctataatttgcgcttctgttcctttattaggcctggacaacgaactaatgagctttggcccagtacaatgtcacttgtatttattttcttatggcaactttgagatagcggaagtgttctttaccaagagccagggagggcccggagtcctgccggctgctgtcccggcccgggtcggtggctgcgtcccgggggagcgagggcgcggtgagagcgcgcgcagagccggcaaagctcggggactgggcttctaggcgaagctaatggggccctcaggaaggcgttaggccctttggaggcccaggcatccctacaggagcagctccctgaggatgaggtcggggggcgcggggcaagtccagggcaagttcccaggcacgagatgatggaaggcgcgaaagtggcatggcttcctcctggcgcagagcagggggtccttccgcaaagactgccaggccaaggaaccctctgagcaagcagatgtactccgcccggtggcctgggcgtctgctttctgctgcaggaacctggcccagctctgttgctctctgggttgggggtgaggtggggtgaagaggatgctttaaaggagttcttggggtcctcggcatgcggggactccctcccttctctttctggtttggccactccaaagggtcgaagttggagaggcctggaataaagtgaagaagcagtgggggttggagggacagaagggtcggcggaggcagtgcggcgtcccttgttccctggcagagagaatacgagcccaccacggggggattgtgggtggggggcaagggaagggaagccccaggaactgcgaggggagcgagtacttctctccgcagcctgtcactttccgaggctcccgccaggcagccctcgttaataacgcctagacaccgtgcccctgcccgccccatctctccttgcctctcctcacttcatctctctgccttaccaccccctccccaccttttccttccttcctgcaaatgggtgttaacgtgggtctttatgttctgtctataactaggatgtaatcacgcaccccatgcctctctctaaaagcatttcataaatgtctattaaagcgctacgaatgtaagatgaatttagtggcgcggctgcctccctgaatccgaacggtaatgatggatttatcaacggggattcgccttcagcccagcgagggaggtttactcagcaaatatgtcggcgagcacccacccaaatgcaatcatttgaccccctgcggacgatagctgccgtgccccttcccaccgctggtcctgcttggccagggtcgctgggggccagaggccggcccggatgaccagagaggtggcctcacggatcccttggcctctcgccccctcctctgtttcctcctctcagcttgaggctctcctggcaagggggatcgatctggcgtgtaggtttggtggggagggagagggtggtggcggtgccagagcacaagatgaagtgtgggctgtcttggcgttgccaggagacatcagtgggtgccatcgtgcccttcttagtttggaaggggcacaattgtacccaagtctctgagtgtgagcttaagtgccctgcttttgaccaaatcttagtgtctgggatcgtggctgactcggcccagccctgggccccattgtaggaaacgtggctgtaggacagaagcctgtggtgcccagccccttggaagggctcagatgtgcccagaacgaatgccttgcctgcccatcctcctggggctccctagaccccaagccaaagcagagatacctgttatcaaaggttggggaagagcctccaaggcaggggcaaaacttccatatctctttcccccaaactgatctagcttctccttcaccttcccccaccgaggccacccggccattttaaagtttagtggctgtggacttttagaatttggtttggtctgtgatccttaccgcacagacccaatgaccaccacctctttctttttgtcttttatctgctctccttttgagggggaggaaagtgctggcctgttccatcaagcccagttcgcatttgctttagcctctgatttctctttcttctttggaaatttcattgagatgtctctgtacttcgcttgtcagttatctttgttccttttaaataaagggcttttaaatggacttattgctcccagcgtgggttcctctctctaaatgttagaaaattgtgccatctacccgctatgctgagtactgtcacactcggagacctcggggacctccgggcaggcttcaatgctgcagtgtcaggggccgcgggcagcaggaggagggggcggctcacgtggatttttacagatctccgcctgcagccggcccgcgtggccacgccagggcacggcccgagacgcgcgcagccgccagcttgatggcggccgcgaacttggctgcagcggcagatctccgaccaaatcgcaggcgtggccgggactcttcgcttctgcagcatacagctggccgagggggagccgcgggtggttttggaccccaacagcaactgggggtcagggataacggaggacaatgggaaagggggagctgcctaggagggggagaggggtggattttgccgcgccgctttggagcgctcccacggcctctccaggccggtctctttccttgggggatgccaggctaggggcagcggagagcgaaagccgcggagtggcttccctgtctcttggccagagagttctggccaggcagttcggctgcaactttcagatccattttctctggtggagatatttctggtgtctttttgtaggccagacttctttcctttaggggagagtggtttagatggaccgaatttgagcagatcaggtgtctgatgtggggtatcttcaccccagccccgcctctgcaaaacacccatccgcaactgcaggttcttttgaatgagttaaaatggattaacagtttggattttattatgtggctccccctcacagatgccttttttgttgttgttttttgttgttttgttttaacccataaggagtattagctaagatttccaagtgtcagttgggtatttatgcttgtgggggaaaaaaaatctccgatacggtttatgacttttattacatgcttcacactgttcgagaaatggagttttaagcaacatacaattaaatctatattgctctttggaaaagggccaaggaactcagcaatcaattagtttagatcttttcatacttgttgctaaaatcaaagtataaaactacaaccctggctatacctaagaatagcttcttttcctattttttttcaagtcatgtagctaacacgtaggaaatggcagctgccttattttcccaagtttcttttttctgattcttctgcctagattagcctttaaataatcaaacgattttctccccccgcccctttctctcattgcagtttctcatctgcctttatctgcctggtttagtttttaaaaatacacttatttgtaatatgtattattttttaaataaatgttccttaatcctctctctttcttcccccttcccttgcctggcagtgagaagggaaacgatgttgtttaataatcacaataatacagtgctttctagacaaaggcaaaattaaattttttataaccacaacaagaagggaatcaacctctctttctctctctctcatctctgtctctttaaataagcagctgaggaaataatctcccgcactgaacagaaactgcttcctccttgaaaatgccaccgttcccacctccctggccctctctgggccaatcccttgggctgtcggctgtctgcctgtccaagaccctggttgggggtgggggtgcgcctatggagatccaggggcgtagtgagaaggcagtggggtctcgctcgcctacgtgcggctgccgaggcggggctgacagcaagttctaaagaggggcagctaatttattaagtaattcttacttcgcttcagcatcctctgcctacagctcccgaggctccggcgaggagggggaggggtctggggctgtgcgtctccccctccgcatttccttctccgccttccaggctccgccagcccctccaccagcctcatcactaattaaaacgccctgtggctttgggactgagtaggccggtcgttgaactgtcatctccgccaggatgggaaatctagaacatcccctcttctgcaaaaaaggttccgaacccagtgaagtgattgggcggagtgtcattaatctctctccagaagctttccttttcctcctggggagtgaggactccggcctttgcctccacccaacacggtcgcccggctaggccccaccatccccactgtcgaccccgccgttgtgcccatccgtatgccctaattgtgaggaaggtctgggaaacattttctttgcgctaattttatatttcccctttcccccttgcaacattaaacataattttgcgctgtcactgtcactaagattgtggtttgctgatgtctctacttggaaacatgaccccttcgcctccaacagggagtcctccccttgcttgcagcctctagtgcggccccttctccagcggggacttcagagcgtttatgaaaatgctggggcggggggtgaggggatggggaggtactgatagtagtaaaggccagaagggttcctaccagaaccctacaatcattccaaaccctcttttcctatgacagcaggagcaaatgtagttttgatgtgcgtttggttgttggcttgtttgtttaataaaatccgtgtgtgtgtgtgtgtgtgtgtgtgtgtgttttaatgtctcagtgtatgtgacaggaaaccactttcagaatttccctttgaattttttttgtttgtttgtttttgtgtctgtcctcctcaacttctctcttttctttattcccctccccactacattttctctggctaagcaataatcccctggcccagtggccacgctcctggagataaaatccatttatcccttgtgttgcctcactgaggcccggttatccagggcctttggcgacagactggaacaaacagagatgaagatattttttcgttttccatacctgctcctcccttccttcaatgtgccagcctagaggggctctggagttgaacaaatgtacccacaactgcaggtttgctctggcgcctggttgtggtcctagttgctatttgtttgtctctttggaaggagctgttagttacattctgctccccacaacagtctcagagcttgcttgcaccaaggttgggaggtttcagagcgattatctcatttcgctggtgcagagggaagctgctggcagcccctggatcagacattcagtggaaggcccatgtcacagacccaacccgaaggttaattttccctcattagcatctccatagtctgctccttgcaagggatctcaggtccttgctgctattttctcccttctcactctttctgacgaattcactctcactcgtggtctcctcatcacaaccttacattctgccaggttcctattgaatccatagactgatcgctgaaaacccatttcatcagtttccaaccagtatgcctatttttaatcctagagcccctctcctccatctgtatctctctagcctcaatgcacctcatttacaaagtgttctgctttatccaaattagttcacttccccccttttactttctcataccccctcattctttcattgagttctagcaaaagcaaaagatacaaaatggcaaagtttgatgggttgggggagaccatcccagccatttaggaagaagctggaggtttgtaatgacagaaaaaaaatgacaaagaaaagagaattgcatttgtggcttaagtgggacaatgtgtttgtgtgtctatatctcggtgtgtttttaagatttctttgaactgcttttgtgctgacccaacaaaggcatttgctgaagctagtcacggtgtaggaactttgagttaacctcttatatcaaatgaatcttttcatttagagaccaataaatctcaatctctagctactttttgtagacccagcttgggttcagtgagacaaaactggggcttataatacagaccagataaagtttgcaaaagttgttttttcccctccatccttttttaccaacctgaaaaatttccccatccaacaaattaaagctcagcaaataaaagtagcagctcttcctcagtgagcagaaggttaggaatttctttagcatttcacagcaaagccttttcactgaaatggttttccaaactcagaggccgaaaagatttatagttcttcaacaagtcattatttgggtgtgttttttaggtggggctgagacaatctaataatcaatgtaagacgggtgggtggggggattggctatgaccaaaagaagagttaacaccagaaacatgaaagccagtctggtctccagggattgaatttgggaaagcctgcacacggctgctcctgggccataaagaaatacattgttaacaacaacaaaacagacaatgccctgagctctgcctggattcagagctgagctactttcaagatattttagcagcactgttcattttgatggggtttctgggccatttgaaattcaacctttagccagcctgctcatggggtatggttacagaattcattttctgatttactacccctcctcctgtattttctttatttcctgatggcctcccatggggttaatcttttttccctttcttttatattttccagttttgttctccccacaaacgactcagtgtttttcctgtttctactgatcactcatttgcttcctttctctctttccttctttaagagccagagaaaaataaaaagaatgagaaggggatttccaaatcgttcttttctaagcattattaattactgttacaaggcaaaagatttttaaccaataacaaagttgtaaattaccactgactttcaagtatttctcatttgtcagctctgattgatttgattaatattccactctgaaataatttcagccggacttatcatcagttctactcatgaagcaaagagcagactatcactgctgcaggggatctgaccactctgcttttactcttaatgtgaagtttggggttttgtcctgaggcccgaggttctgggaaggtgtacaggcagttaagtttcggggatgaagtggactggcatatctccatatattcagttatttatatgtaattttgaaaactttgttcaggaacctatttgtattgaaagaacaaaacggcatcatttccttgctctcctgaacatttttttttaaactgaatattcaaggctgaaggaatgaatttttaaacagttcctaaatccaagaaactcattcgaaccctattaattcttatcctactggatagcatttctgagaaagagtgggcctactctctgctcagacctatgggagatttgggttactggtggggaaaaaagtgtgtgcagggacaggagggtgggaggggctcagcacaagacaggggcagccagaagactccacttttggggagtggggttatagtttcccaaggtccttttccgtgccatcgtcatatccagaatgtaatttttgaagctatcaatacccgctgcctccaatacctctcgagttttaatcttaattatattattaagtgaagtactctgctgtcagggcgttgaacatgatttatgacgtctgcctattaggggatcgattgtgaatatcgccactatcatctatcaatattctcaagccgggggtatttctcgctccacggtagttatttgtaataccgaaatgatagactgcaggaaaagactacttcagaggactcgcttttcaggagcagcagagagtgtggtgaaccaggagactcggagagttccaaccacatctgacacccagagagagtttaaagtttttttgtttctgttttttaatgtaaaaaccagtgaattctcccgtggggctagtagaagaaagcaagccagagtcgtttttagggaaaggagtaacctctgcaggtcgatatcagggggcgagggtttctagctgccaggtgatttgcaatcagactagaaggaaaaaactggcaaccaggggcccctttataggaagatggctggatgagggctgcagaggggtgctgggggtagactgcgtatttctgcagcagatgcccggtcgctatgcccgtggattcggaggtgttcagtttctgggatcaattaagactcgctggctgagccctcgctgcatcgccgctttcacctgctcctgcttcctctgcataggtggaagcccgtgccaaagacctagtggccaggcccgagggagcctgaacgcagaggccttttgtctccagacagagagcagcgcctgcttttttccactctcacggggcacggcactgggtcaccagcgagtctcagcctccagcgttagggggatgggaggaagagtcagagaatggagcaaaactctcccgttctggcggcctggagctggaggctagaacaccccgggggggtggggcgtggagggcggcctgagtgccgcgcctggcccctgccctgggtgcgcaccaggccgcgaaagccgggggccgccttctcggctgctgaagcccgggagtcagtcaagcgccctctggcaccgcgagggaggcgcacctcgcctggtgcagagttgccgcgacccgagcgggaggaggcacaggacgcagggctcctggcctggctgtgggcttggccttggcgcactaagcgctccccatctgcccgagcctggcctccgcggccctctcggcccagtctacgttcgtttaaggacttcagcgcgaagaagagcgaacgtggctagaacctgttgacctctcctctggcctggaagtccgcacagctcgtggcaacactggacggactggttgtcaggggacgaccgcgggcaggtggggaggaggccttggtctggctcctggattccaccctgggacggaaggggaagcggaaaccttgacctcagccacacaaggacacctatctggctgtctgcctgccctggcccagccacccggttcagaggcctacccttggccacagtggtttgtcctcaggcttggagtccccagagatgtggacacagtgactggcacatagtaagcgcttaataagtgttagattggcggtgtcaatcatttttaggcacatccggtttcctccgtgagcatctcccctctcacacacatttattccaggccaacaacatgcctagctaggtccttaagcaccgccactcatacccagaggcccatcagctgcctcgctccctctgagccctggagctgcagccctccacccttgacatgcgggagaaagccagaggcccctagagtccccccctcggggtgttttccaggcctgggacacctgagcaggagacacagaggcctgaagaagggttagcaggtccctaatatgccccatccatgtcagcactagaggaggggaattctggttaaataagaatattctggacagggagatggtggttggtcagttaaaaaagagagaatcattcagtaagggatgcatgtgtgggaagagtggggggcacctaggggcaggctgacgcagaagaagcaatagaggctgagtcagagcaccacaatgacacctttttcttccagaa

SEQ ID NO: 35 - DNA, 164417 bp, Artificial Sequence
  Synthetic BAC sequence
attccagcattcagtacttcaggctcatcttcaaaaaattctttcctagactagaccacagtaaagttcccacttaacctacccaatgatctatgaccctctgaatctaatcagattttttttttttaaacctcaaaatagacccaggagtttaagatgggtatctactcaaagatgggactctacttaagtcagttttatggttttggcaattgtgatctcattgccaaaaatctctggacatggctaaatcaatctatttgatgagtatctatatcagacaccaaaaaacacacagggcaagaaccaaccaacaaaacaaatctgtggaagccaagagggtccagaaccaaaagggcattctcataccaaggaactgatgagagagaacactagaaagcttacaaaatgaggggagaatcgcctgtcaaactcccgctgagccaggattcctccctgtccaggtgcactggtagagccaatctgaaaagaagaaaagaacgacattaagggaagtccacctcatgaagttccacctcatctactctgagaaagggcagtcccaaccaacccaactctatgcattagagtcttagttcccaaaggctcagaagaacttcaagaagatgagggaaagcttttggctagagagagttggatgattctctcttagtgtgttataaagaggagtacctaggagccagaagacctgagaaataccccatggagaacatatattaaacaaggtaggccaggcatgcaactgaaattaaagccaaattcttctgtctgagcctcagactctgcaaagagtgaagttgctcaccaccactggtccctctacagggcaaggtgtgcgtggaatgacttacccttggtaatcatttacttaatcctccagcaaaaatccactacttcacagggttaatgtgaggctcaaatgaaatagcaaaaatatataatgaagtataaagccctacccaaatgtacattattagaggaggggttgagtctggtccacattcctttgtcttggagaggaagccaagagtttggagcacactgcaaacaactttattccaaagtggcagcaaagcctttgattttatgtctattaacccatcaactaccaggtagaaccaaagagtcctgaggttggttctgaaagcagaaatgataccggatgtgaaaacaccgctaggtttagaagaatatggttccatgtagtttatgaaaaacgaaaatgcagaaggtgcaatgaatgttagttcttttcattctatggttgactgtgttaagtcccttccctactgtgtactaattagcctacagccctactggtatggaggatcacacattttggcttcataaatttatacatttatttggctttatacatttatgacttaagctttttgaggacttggacagtatattaatcctcttggtattccccagagtctggcacattgcaggggcttcataaatgtctattgacctttacatcaatcaaaagactgtttactactgagtttctatcatatatgggaaaaagaaatctaagacagttactggcctcagggagtttataattaaattgggaggtgggggtggggagagggaagatctataaataagaaacaaactactgaagacagtgattaaatgttcaagtgccatagactataagtgctacagaagtttagatgcagtcaatatatgtttatgaaagaatgaatagtggccgggcacggtggctcacgcctgtaatcccagtactttgggaggccgaggcgggcggatcacaggtcaggagtttgagaccagcttggccaatatggtgaaaccccatttctactaaaaatataaaaaagtagccgggcacggtagcacacacctgttgtcctagttactcgggaggctgaggcagagaatcgcttgaacccgggaagtggaggttgcagtgagccaagattgcgctactgcactgcagcctgggtgacagagtgagactctgtctcaaaaagaaaaaaaagaaaaaaagaaaagaaaaaagaaaagaatgaatagcaaagagcaatatgaactgaaggcagaaaacaaggagacatagctcaaagctgggtcttgagaaggcttcagatataatggagtggagggaaaagggtacttcaaacagaacaaaggcacaaaggaaagaataaggactgagttgggggagaaggtatgggaagtagcttggcctaattaggatgtagggtctgtatgggcagagtgggagagaaggctggaggcagaaaatagctagactactggaggggggtgcagtgagaggcagaaaagctcagccctgatgccgtaagcaggagcaatctaagcaagggaaggagagagtaacagtggagactgggaagaatctgacagtggcagagaagacagatcagaaagacaaggacatcagtaggcagcaaatgacacactccagatgaaaaggaaggcagaaggaatgaagagaaggggaaggccatggtacacctctcccatccatttcaatcactctagtccagaactttaatttgaaacatacttccttaggacaataccaagtgtctggttaatgttatctccctcagaatttagtagctactgtgtaaattttctgtaagaggtttttgtttttacaatctatactttttagatggatatccatcaccttaaacatttatcttttttttgagacagggtctcactctgttgcccaggctggaatgcagtggcaataaaatggctcactgcagcctcaacctctggggctcaagcaatcctcccacctcagcctcctgagtacctgggatcacaggcacgtgcaccatgcctggctaattatttgaaatgggggtctcaccatgttgcccaggctggtctccaactcctgggctcaagcaatccacctgccttggcctcccaaagtactgggattacaggcgtgagccaccacgtctggccgcatttatcttttctttatgatggaaatgttcaaatgcttctcatctggctattttgaaatatacattagattactgttaactatagtcaccctactaaactatcgaacactaggtcttattctttctaactatatatatatattttttgagacggagtctcactctgtcgcccaggctgaagtgcagtagtgtgatctcggctcactgcaacctctgcctcctgggttcaagtgattctcttgctccagcctcccaagtagctgggattacaggcgcctgccaccacgcccagctaatttttgtatttgtagtagagatggggcttctgcatgttggccaggctggtcttgaactcctgaccttaggtgatctgcccacctcggcctccaaaaatgctagattacaggtgtgagccactgcgcccagtcctaactgtattttggtatctattaatcaacctctcttcatccccctcttacccccaccacaagagattttaagggaaggcagatccaaattccatccagctaagggtttgggcaactcaccacaacgggcccatcctcctgggccaggtaagtaattgttgccgaggtgaagttgaaataaccagccttgagagggcgcaggaccacagtgtgggagacattgctagcactggctcaagagttaaggaacggaaagagatgaagctaaagttgtagcagcctttcaacctgtggactaaatgcaccacttacaaaacatttgccaatacatgctgatctcatgccggcaatattctgcaggaatgaaaaaatataggcttctttgccgggcatggtggctcacgcctgtaatcctagcactttgggaggccgaggcgggtggattggctgagttcaggagttcgagaacagcctgggcaacacggtgaaaccccgtctctaataaaatacgaaaaaattagctgggcatggcagcatgcgcctgcagtcccagctactcgggaggctgaggcaggagaactgcttgaacccgggaggcggaggttgagtgagccgagattgtgccactgtactccagcctgggtaacagagtgagactccgcctcaaaaaaaaaaaaaaaaaaaaaaaaaaaaaaatatatatatatatatatatataggcttctttttaaaatttactgatttttttaaatattaaaaaaaaaagagagagagatggggtctcactttgttgcccaggctggtctcaaaatcttgggttcaagtgatcctcccaccttggcctcccaaagtcctgggattacaggcatgagccaccatatggggcctaggcatcttttttaaatctaaagtgtatggtatttttttccagctaaattttaagggtcccatgttatactcagtgtcatggtttttgaagtaaacttccaaagcaatatatgttatggataaaaaaattatagtcacttggccaggcatgggagctcatgcctgtaatcccagcactttgggaggccgaagtggttggatcacctgaggtcagaagttcgagaccagcctggccaacatggcgaaaccccgtctctactaaaaatacaaaaattagctaggcatggtggcgagtgcctgtaatcccagctactctggaggctgaggctggagaatcgcttgaactcgggagccagaggttgcagtgagccgagattgcaccattgcactcaagacaagagcgacaagagcgaaactccatctcaaaaaaaaaattacagtcattcaatcagtgcttcttcttggatgattaaaagaaattatagtcacttaagctcacagaaaatcttttttttttgtttttttttgacagtctcgctccgtcgcccaggctgaagtgcagtggcatgatctcagctcactgcaagctccgcctcctgggttcacaccattctcctgcctcagcctccagagtagctggaactacaggcgcccgccaccacgcctggctaatttttttgtatttttagtagagacagggtttcactgtgtgttagccaggatggtctcgatctcctgacctcgtgatccacccgcctcggcctcccaaagtgctgggattacaggcgtaagccaccgcgcctggccaagctcatagaaaatcttttgttaactataattgaaggaaattattgaaaatacaaaaaaaaaagacaaaacaaaaacaaatacaaagaccacatttaccctcaccaataaacctaaacgtatacataattattattgatatgatttggatctgtgtccctgcccaaatctcatgtggaattgtaatccccaatgttggaggaggggcctggtgggagggaattggatcatgggggcagatttctcccttgccattctaatgatatgagttctcacaagatctggtttaaaagtgtgtagcacctcccctcttactctcttcctcctgctccagacatgtaagacgtgcctattttccctttgccttctaccattataagttccctgaggcatccccagccatgcttgctgtacagcctgcagaaccgtgaacaaattaaacctctttttttaaaaattacccagtctcagcttattcttcatagcaacttgagaacagattaataaaatacaattaattattatttaagagactaggtctcactttgtcaccaaggctggagtacagcagcactatcatagctcactgcaggcttgaactcccaagccctagcaatcctctcacctccatctcccaagtagctgggactataggcatgtgccaccgcacctggcttaaatatactttaattcacaggaagaaaaataccatctaattcaatactcaggagataattggtagattagaataagagactcactgaataagagactttaaaaggtcacccagatccttcatgctagcatcccagtgaatttcttttttttatttttgagacagagtcttgctgtcgcccaggctagagtgcagtggcgcgatctcagctcactgcaacctgcacctcccgggttcaagcgattctcctacctcagcctcccgagtagctgggattacaggctcccgccactgcgcctggctaatttttgtatttttagtagagacggggtttcactatcttggccaggctggtctcgaactcctgacctcgtgatccacccaccttggcctcccaaagtgctgggattacaggcatgagccactgtgcctggcctgaatttcttttaaaagcaccttaaatacctttgtccagccacaaacatctttattaagtgtctatatcctcccagtatagtatgtttcaggtttttttttttttttttttttttttttttgacacagagtctcactctgttgcctaggctacagtgcagtggcaggatctcggctcactgcaacctccgcctcctgggttcaagtgattctcctgcctcagcctcccaagtagctagactataggtgcgcgccatcatgcccagctaatttttgtatttttaatagagacagggtttcaccatgttggccaggatggtctcaatctcttgaccttatgatccacccacctcggcctcccaaaaatgctgggattacaggcatgagccaccgtgcccagcttgtttcagggtcttataatctgaacttcagtatcctccttcttcatgtctactctaaatcatgctcacacaatttacaccaacctctcttgctccatcttatccagagagatgacaggaggacagccacacatatccagcctatttgaagtacccctgctgctttgcaggcaaggctctccctgccccccgacccttcatcaccaagtgccaagaggatacggggcaatccggtcccatttgacattgagcattccagacacaatgccaaagtcttctggagggaaggaatcatcagatagttccacgtctaatgcagcactagaaaatggatgaaacaaaaagggttagtaagtaatggatataaaattaaagcaggccgggcgccgtggctcacgcctgtaatcccagcacttttgggaggccgaggtgggcagatcacctgaggtcaggagttcgagaccagcctggccaacatggtgaaaccctgtctctactaaaaatacaaaaattagctgggcgcggtggtgagcgcctgtaatcccagctactcgggaggctgaggcaggagaactgcttgaaccctgggaggcggaggttgcagtgagccaagatcgcaccactatactccagcctgggacagagcgagactctgtctcaaacaaacaaaaaaattaaagcaatagtccgggcgcagtggttcacacctataatcctagcactttgggaggctgaggctggctgatctcttgaggtcaggagttcaagaccagcctggccaacatggtgaaactccgtctctaaaatacaaaaaatcctgtctctaaaaatacaaaaattagccaggcatggtggtatgcgcctgtaatcccagctactcgggaggctgaggcaggaggatcacttgcagctgggaagcagaggttgcagtgagcagagactgcaccactgcactcctgcctgggtgacagagtgatactccatctaaaaaataataataaaaaaattaaattaaagcaataaacaatcaaacctgcctgcttctccaaaaaaatcagaattgcaaaagatatgagtaatatagcaacttggttctgttgcactgaagaatccaggtcaaggactggattctattgctcagaagcaccaaaataatcaagtatccaggaggcaataggtccaagttcatccttgcctcaatttttcttcatgtacatgcctatgtgtgtggagggagggagaagaggaacacagtgaatacagaggagaaagttataagggaataaaatgaaagaaaggcaacaaaaatgctctaggctaatgaaagaaggaaaattacacttttttttttttgagatggagactcggtcttgtggctcaggctggagtgcagtggcgcaatctccggctcactgcaacttccgcctcccgggttcaagcgattcttttgcctcagcctcccgagtagctgggactacaggcgtccgccaccacgcctggctaatttttgtatttttagtagtgacagggttttgccatgttggccaggctggtctcgatctcctgacctccagcaatccgcccgcctcagcctcccaaagtgctgagattacaggcgtgagctaccatgccaggctggaagatgacactttaaacccctgaggtaacaagggattgtgtattttctgtgtctttatctttccctcctagtttttccacaattcttgccacttccctactctaaaattcttccaacccgaaacgtgaaagatggtttcttgtagcttaggtaagaatgtcctcctttccaaaagtagatcccgaagtgtattcattcactcaatatatctgatgctggaagtgtcccaaagagaaaccactacccaccaatatgctccctattcccatctgaaaactaagaatccagaaataggcttaatctgtaactctagggcctcgagttaccttgagccaacattgtagatgttgtactgcaaggtcaggtctcgtccctccacggcgtatctgttcagcagtgatttggaagccaaaagcctggctccttcctctgcttgagtgacagcaaatagagccaacaccacaaatgacagcagcctcatctttagagaaaaaagcaaagtgagttatcaaaccaagtacgtcaaattcaccaaaatcctcttgacagcgctcccgtagaaagctccttcgatgctaccagaacagcagccccttccacagagtagtccataagccaccagagcagacccgttctccagactctcctaccatcttcaccctgcagccctcgaaaaaccggtacaagcaccaatatatctactgccctcttcctgtcagaagccccgggatgcccaccggctggtggagtcttctgaggggacaccatgtggccagagcagggcttccttggggtgcctgatttcggccgatctcggacctgcaggagcctgtagctttccctcacacaggagtgcccacagccttcccgctgctcccctcctccttggccacagctctattgggatcccaccgcggactcgcggggtcctcctcacatccctgtaccccactctccagtccagcccctgagatcccattcgtcctcgcctgtcacatccctttcttggtcccacgggcgggggggcgggggtcaatcacctctgccccccgcctcccgcctcttgcaaggttacacgtcctccagccaccgcgtcctctgcccttcccgccctcccctagctaacccccagccacggggtgatgcgcggacacgaggctctcgcctctcccgttcggacgccctaagcctccggacttaccgttggcatcccaaacgcctttccggagccacaaagacaggaagagagcgtcagcatccgaaagaccggaaataagcactggccggaaaccgtggtgttccgcccaatgccttgtgggagttgtagttcttggagaagccccacctttccctttgtagtgcccgcctgcctgagaggctgtgagcgctcctaagaggtttgtgcgttctccaggcttcttattcggccctctttggggggcttttcaagctgatttttcactactgtatgtgacccgcacctcattaggtgctttgggaaactagcaaacctagaaatttggatcatctatctaaaatgtcaactagtactgtcgaacagagaattagagaaaagctattccaaccagtattttttctattctcagacaagacacatagacattccctacatccagcaggtcaccgagccctgagctttatttagaagccctttgaagtgccaaaaaagtagatctttttttctccattcctactataactgcttcagttcttgctggtttctggatgtgggttttactctagtagtctttctatcttaggtctttcctgcactttttatttttatttattttattttattttattttatttttgagacagggtcttgctctgtaccccagggtggaatgcagtggcgcgatctcagctcactgcaacctccgcctcccaggttcaagcgattctcctgcctcagcctccccagtagctgggattacaggagtgtgccacctgcccggctaattttttgtccttttagtagagacggtgtttcaccatgttggccagactggtctcaaactcctgtcctcaagtgatctgcccaccttggcctcccaaagtgctggaattacaggcttgagccaccacgcccggcctccctgcactttttaatcagctgccaaacttcccaaaacagcattttgaacagtagatcttaggttcagaggatgaactgtgaagttaggcagtcatgaattcaatcccagttctgtcacttactggttaggtaaccttgaacaagcattacttatataacaccttggttcccacatctgtaaaacaagataattatagcactcacaaaaggttagagtatcaaataagatgatgtatgtaaaactcttagtacagtgcctggcacatgtatgtgctcagtaaatggtaattatcagtattgctgttattctatacctcccttgtagcattcctgcattcaatatgcgtttactgagcacctactttgttcctggtgctgctgtaggttctggagatacagtgataaataggacagatatggtttctactttctgggggttacattcttgtagaataatacacattgcctgtatctgccttagtatctgtccttccattctccacctccaagattgcagcttcttgagaaaaggttgtccatttcccgttgcttagtgtcttgcctgagcacacaggaagtagtccaggaattaataatgacttctctacatacaacctccaatctgctctgacttcaggccttggtgtgtggcttccctgaaatgtcctactgcctctctttcttatccaaatccagccaatccttcaggaccctgttctggtcttgtcctctctgggaagccctccttggctttgagctcttttacacacaacagtttatttgttttcctttaattgtttctggcttgaaaaatgtaccttaggccaggcacagtggctcatgcctgtaatcccagcactttgggaggccgaggcgggtggatcacgaggtgaggagatcgagaccatcctggccaacatggtgaaaccccgtctctactaaaaatacaaaaattagctgggtatggtggcgcatgcctgtaatcccagctactcaggaggctgaggttggagaatcgcttgaacccaggaggcaggggttgcagtgaaccgagatcgtaccactgcactccagcctggtgccagagcaagactccgtcttaaaaaagaaaaagaaaaatgtaccttaatgattaggtcctatttctgtagtgtacactttttcaagggcaaagaaagtgctcaagaaacgtctgctgattggagaaatttttttttttgagacagagtctcactgtgttgcccaggctggagtgcagtggtgctatctcagctcactgcaacctccgcctcccaggttcaagcaattctcctgcctcagcctcccaagtagctgggactacaggcacatgccagcatgcccagttaatttatttgtattttcagtagagacggggtttcaccatgttggcaggatggtcttgatctcctgaccttgtggtccgcccgtctcagcctcccaaagtgctgggattacagatgtgagccaccacacccagccaattggagaaatttttattccttccttccttcctttttctttctttcctttttttttctttttaggcagagtctcaccctttgcccaggctgagtgcagtggcacaaacatggctcactgcatccttaacctcctgggccagctgatcctcttacttcagcctcccgattagctgggaccacaggtgtgccctaccatgcctgggtaattttttttttttttactttagggacggagtttcgccatgttgctcaggctggtctctaactcctgggctcaagtgatccactcgtctctgcctcccaaagtgttgggattataggcatggcccaccttgtttgctcaaatattgctttctagagccatttcttcaggaccggaaagatggacagtgtgggtgttcttgtttctcagactctgctgcacctgaaagcaatgtatctttagcacacactctttggacaccttactatgtagccacttctaggtccagaagagaaatgtcttcatctttgggttgcccacttatacactgacccttttcctgcctctatcccatccgagtcacttgttctttcattagtacatttagcattcattttttgagcacctgttatgtgtcaagcactgtgatagtgactataagagatacaaaatagggccaggcacggtggctcatgcctgtaatcccagcactttggaaagccgaggtgggtggatcatgaggtcaggagttagagaccagcctgaccaacatggtgaaacccggtctctacgaaaaatacaaaaattagccgggcatggtggcacacccttgtaatcccagctactagggaggctgaggcaggagaatcgcttgaacctgggaggtggaggttgcagtgagccgagatcgtgccacttcactccagcctgggtgacagagtgagactccatctcaaaaaaaagagagatacaaaataggatatggtgcctgccctcaaggaggatgacctatagtcctaaccataatgaaaagacaaatgaggtgtcaagcactcctcaaaaaaacaaaaacaaaaacagtcaggcaaggtggttcacacctgcaatcccagcaccttggaaggaaggactgcttaaagccaggagttcgagaccaaccttggcaacaaagcgatacctgtctctacaaaaaaaatttttaagcagccaggtatggtgccatgttcctgtaaccccagcttactcagaaggctgaggtggaagcatcgcttgagcccaggagttcgaggctgcagggagctatgattgcaccactactctccagcctggtgacaaagcaacaacctgtctggaaacaaaacacatgggccgggtgcggtgggctcatgcctgtgatcccagcactttgggaggctgaggcaggcagattacctgaggtcaggagttcaaaaccagccctgccaacatggctaaacctgtcaccacagctggctaatttttgtatttttggtggatacggggtttggccatgttggccagactggtctccaactcctgacctcaagcgatccacctacctcggcctcccaaagtgttgggattgcaggcatgagccactatgccccgcctcattttttaactcatttcagtttaagtttgaatagctacatgtgactagtatatggaacagcacagctctagtgtactctgacacatgtctggactttggcttttgaaatgcaaaagcccagcattttgctactcagaaagcattttctctgctttttctctgaaacaattcttcctccatcattgggaaagctcgggtctgaggcacaggatgtgggacagctcccagtgagtccccaaaaaacctccaaatcttgactgaccccattgaatgtctgaacccagggaagataccttcctgaggtagatgcttctaggtatgcaaagcacacggtataccccttcctcctacacacatgaaggatgtccgtgtcctctcagccccttcaccctcttgttccctctcagcctcacagccagtaatgaggagccattttagcataagggcatatcatcctgagaggcagtctctcaggatgagagcgacagcatgacttgttggtttggttgtagatatcatactctgaagatggaatggcgacgtcagtgaggaggccagaaacaggggtctcctcgacctcacccaagaggcagcagcaggaagaagtagggctccaactaaaagcgggaaagtagccgggcacggtggctcacacctgtaatctcagcacattgagaggctgaggtgggtggatcccctgaggtcaggagttcgagaccagcctggctaacatggtgaaactccgtctttaataaaaatacaaaaattagctgggcatggtggcgggcacctgtaatcacagctacttgggaggctgaggcaggagaatcacttgaacccaggaggtggaggttgcagtgagtcgagatggcaccactgcactccagcctgggcgacagagggagactctatcttaaaaaaaaaaaaaaaaaaagcggcaaagtagataagaacaaggcaagggtcctttgtgaaaagggacttccgggtatctgctccaggctggctctggaagacaactttgggagaaaaggcatgcatgcacatcctacctcccggaccaggagtctatgtgtgttaccaaccagctaccaaggagtctcttttcttttccacaatgagctgtgtgcactcagtctcctgccagacactaggggacgctggcagtgtcggcgagcctctgcgctgtggtcctgctctgccactgcatccaccacgctgtagtcagacaacttgtcccagctctttcccctccctggactgtgagtacctacagggcagggacacacctcgtgtttgtggaatggcttccccataagtagtcactgagcataactgagccacgcagggagaagaaaatcactgctgctgaccctgcaatggtcaggcttggctggaaaaggacaccagattccagagccaagaacagtgccccacgcacaattatttattttgaaacacttcaaacctacagaaacttgaaaaaatggttgaattaacacctgtatacctttcatctggatttatcagtcactaacattttgcccatttgctgtcactctatatgtaaattaatatatgtatacactgtcttgtgccacataatgatgttttggtcaacaatggactgtatatataatggtggtcacatagattatgatactgtattttcactgtaccttttctatgtttagatacacaaatatcatatgttacaattgcctacagtattcagtacagtaatgtgctgtataggtttgtgccctaggaacaataggctgtaccatactactgccaaggtgtataataggccatgccatctaggtttgtaagtacactctatgatgttcacacaacgacatcacctaacaccatatttctcagaatgtatcccgtggttaagtgatgcataactgtatatgtacagtcgtcccttggcaaccttaggggattcgttgcaggaccattgcaaataccaaaatctgtagatgctcattatctttatataaaatgacagaatatttgcatatagcctatgcatatcctcccatatactttattctttttgttaattttttttataattttgtttaataaagtagagcagccgggcatggtggctcatgcctgtaatcccagcactttgggaggccgaggcaggcggatcacctgaggttgggagtttgagaccagcctgaccaacatggagaatccctgtctctactaaaaatacgaaattagccgggcacacctgtattcccagctactgggatacagtagctgggattacagctacttgaagctgaggcaggagaatcgcttgaacccaggaggcagaggttgcagtgagccgagatcacgccattgtactccaacctgggcaacaaaagcaaaactccgtctcaaaaataaataaataaataaataaataaataaagtagagcagaatctcactatgttgtcccaggtcagtctcaaactcttcaagcgattctcctgccttggccttccagagtgctgggattacaggcatgaagcattgcacctggcccctaccatatactatttatttatttatttatttatttatttatttatttatttatctgagacggagtctcactctgtcgcccaggctggagtgcagtggcgcgatctcggctcactgcaagctccgcctcccgggttcacgccattctcctgcctcagcctcccgcgtagctgggactaaaggcgcccgccaccacacccagctgattttttttgtattttttttagtaaagacagggtttcaccgtgttagccaggatggtcttgatctcctgaccttgtgatctgccaatctcagcctcccaaagtgctgggattacaggcgtgagccaccacgcccaacttatttatttatttttttgagatgcagtctcactctgatgcccaggctggtgtgcagtggtgtaatctggggctcaccacaacctctgcctctcaagttcaggcgattctcctgcctcagcctcccaagtagctgggattacaggcgtgcgccaccatgcccagctaatttttgtatttttagtagagacagggtttcatcatgttggccaggctggtctcaaactcctgacctcaagtgattcgcccaccttggcctccccaagtgctgggattacaggcatgagccactgtgctgggcctaccgtacactttacataatctctgggccaggtgcagtggctcatgcctataatcccagctgtttgggaggcagaggcaggaggattgtttgagacaaggagtttaagaccagcctgggcaacatagtgagactctctctatttttttttttaattaaaaaaacaattttccggccaggtgaggtggctcatgcctgtaatcccatcactttgggaggccaaggtgggcagatcacctgaggtcaggagttcatgaccagcctggccaatatggcaaaatcccatctcaactaaaaatacaaaaaaagtagccgggcatggtggtgtgaacctataatcccagctacttgggaggctgaggcaagagaatggcttgaacctgggaggcagaggttgcagcaagccaagatcttgccactgtactccagcctggacaatggagcaggacttcatctcaaaaataataataataacctccaatctgcagttagtttaatctatggatgtggaactcacaaatacagagggctggttgtatacacattcatatatacttcttttttttttttgagacagagtctcactctctgtcccccaggctggagtgcagtggcacgatctcgcctcactgcaacctctgcctcccgggttcacgccattctcctacctcagcctcccgagcagctgggactacaggtgcccgccaccacacccggctaatttttttgtatttttagtagagacgggatttcactgtgttagccaggatggtctcgatctcctgacctcatgatccgccagcctcggcctcccaaagtgggggggattacaggcatgagccaccgcacatggcctttttttttttagacagagttttgctcttgttgcccaggctgcagtgcaatggcgccatctcggctcactgcaacctccacctcccgggttcaagggattcttctgcctcagcctcctgagtagctgggattacaggtgcctaccaccacccccggccaatgtttgtatttttttgtagagacaggggtttcaccatgttgaccaggctggtctggaactcctgacctcaggtgatctgcccacctaagcctcccaaagtgctgagatgacaggcatgagccaccatgcctagcttctttatgactttcaaaagaaaactagaatccaaccaagaatcgcatattacagcattgtatttgaccaataaagtttagactaaaccaaatgagcttctcccctagagagagcatggagaaaaaggagaaatgcatggtagatagaagaactttggctactgagaggatgagtagaaagaggagcggagaaggctcagaaagagctcaagctcctgaaacagactctgaagggtcctttctaagtcctgggatcacttgaaaatcttggacagacctggccaccccaagttgaaagtggatggaggactattttctgcttcttgccaaatttctccccaacacatgcaaattccaaggtggattctggaatctatacctgctgtcttgatgtcttttgaggtttcatcccattttcagaatttgaccaccgtctcctcttctccctttctattagcccaggtgggagctgggggaggggttgagcaggcccagcctcctcttgctgaagagtgacaaaggagtgtgtgtgtgtgtgtgtgtatgtgtgtgcaagtgcgtgtgcgtgtgcatctgtgtgtgtgcatgcatgtgtgtgtgcatgcatgtgcacatgtggcctctcacatccttcagaggagccctccttgaacccatgggcccaggaccctaccctcctgttgctatgacaaccacttccgtgaggactccgggagtaaagaattgtgaatgtgtggtgagggagggagggggacatgccagtctcatggcattagtgatcatagagctctatgataatgaagaagaaagagaatgggtccaggccgggcgcggtggctcacgcctgtaatcccagcactttgggaggccgaggcgggcagatcacgaggtcacgagattgagaccatcctggctaacacggtgaaaccccgtctctactaaaaatacaaaaaattagccgggcgtggtggcgggtgcctatagtcccagcaactcaggaggctgaggcaggagaatggcatgaacctgggaggcggagcttgcagagagccgagatagtgccactgcactctagcctgggcgagagcaagactccgtctcaaaaaaagaaaaaaaaaaaaagaaagagaatgggcctttatcgactctcaaagccggcagggtatgggacacagccaggagcaagggcagggtgattcctgaagttctgcttggtgtttatttattttacagtgtcactctcaggatatgggctgctccattctttttttttttttttttttttgagacagagtctcatgctgtcacccaggctggagtgcagtggcgtgatcttggttcactgcaacttccacctcctgggtttgattgattctaactcctcctgagtagctaagattacaggcgcacaccaccacacccagctatgggctgttccactcttaattggactctccacctctcccttaggagatcaaagaagcttggggggcttcaggggaagaaaatccctcctttaacaaatttgctgtatccttgacatccatcaacagcttcattgatgacttgggctaccaagggagtcaggagctgaccagtgtaagtgccccaccctgcatccctcccacccctcaggtcttgcacccctgttctaccatcatttgagcactttagctcactaagaaatactgtggcaacctcccgtgcattctctacatgcttttgattcgtatctttactaaaacatggctcaaatttgctttgaggctggactcggtggctcacgcctgtaatcccagcacttttggaggctgagttggatggattgcttgggcctgggaggttgaggcttcagtgagctgtgaatgccccactgcactccaacctgggtgacagagggagatcctgcctcaaaacaaaacagaattaccactttcagaaaaaaaaattccaccaccaataataatagtaatatcaacaataatagtaatcatagctaacatttattgagtacttaccacatggtattttgtaagaatttacatctcatttaactatcataacaatcctataaggcaggtgctactattttccccatttttcagatgaacaaactcaggcacaggcaggttgaataactctcccaagaccgcataagtagaaagcaaagatgctagagtttgagctcagtttggctcaagagttcacacacaaaagaaccacctcccagttagccactcgattcttattagtccttcctaatatcctttcaatactcatatgctcttaaacgcacttggtataggaacttcttctttttttttttttttttttgagatggagtctcgctctgtcacccaggttggtgtgcagtggcacgatctcagctcactgcaacctccgcctcccgggttcaagcaattctcctgcctcagcctcccaagtagctgggactaccagcgcatgccaccaggcctggctaatttttttgttttgtatttttagtagagacggggtttcgcagtgttagccaggatggaggaacttcttaattgtctgtttgagggagggtttaaatgctagctgttttttgcttttgagctctgacacacaataaactgtacatatttaaagtgtacaatttgataagttttgacatatatatatatactcatgaaatcatcaccacaatgaagataataaacgtatccatcaaatatgaacaagcaggattgttcaaatatgaacaagcaggatttctagagcagataaattaatgggtgattatttgccttccaaaatgagttttttttttgagctggagtcttgctctgccgcccagcgactctcctgcctcagtctactgaatagctgggattacaggcacgtgccaccacgcctggctagtttttgtatttttagtagagatgggggtttcaccatattgggcaggctggtcttgaactcctgacctcgtgatctccttgccttggcctcccaaagtgctgggattacaggcgtgagccaccgcgcccggccaaaatgagtctttatttaacctaaatatttgcattacaaccctttgaaaagaatgagcatttggccgggcgcgatggctcacgcctgtaatcccagctacttgggagggcgaggcaggagaatcacttgaacccaggaggtggaggttgcagtaagcagagatcacaccaccgcactccagcctgggcaacaagagtgaaactccgtctcagaaaaaaaaaaaaaaaaagaatgaacgtttaatgcattcaggatatgcctgtgtatcctttgcagatactgctttgtagcttgtctttagtattttaagtgaacgtgtcttccgggccaggacagtgttttttaacctctgctgtctgctcagttctcacagagagatgggcgcttggtttaggtttgctctgtgatctccatgcttctctgcggcacttcgcctctccgccaacgacagaggcgaagtcccatatgtaacaggatgggtcggtggagagcatgcttcattccttgctcttggattcccccaaggaagaagatcccagccttgttcagacgaagaggcggaagcagaacaaggtttgcattctccagatgaggaaaaatgaggtgaaagaggaagacaaggaggacaaggaggatgaggaagaggaggaggaccagagagaggggccccctacctctttgcaatcacctaggacaggacagaggcaatgcccgtactcaagaatccgccaagtgaggcacaaggagcacctgagcatcttggaaagtggcttgagcttatccaccaatgaaaccaagttgtctgtccatgtttttgccaatacttatgtagctgctgccacaggaagcagaagtcagtggaggaaaacaaggcatccgactctggagcaaggaggagcccgggtgagactgactcagctgtgagcttcactaatgggtgatggtccagatctccacggggctccaaggaaagctctgggcagaagccagaagagcagagtgtaatccttccgcttagaaataaagcacattttatttttgtgaatggcatgtgtgagcctgatgattccaggttttttttgttttgttttgttttgtttttttgctagatgtattcaatccctgccccactttatctctctgaacatcccgtttgcttgctccttccttccttgcttgaccccaggagtttgagaccagtctgggcaacatggtgaaatcccatctctacaaaaaaatataaaaattagctgggcatgggctgggcgcgacggctcacgcctgtgatcccagcactttgggaggccgaggctgtcagatcacctgaggtcagaagttcgagaccagcctggccaacatggtgaaaccccatctctactaaaaacacaaaaaattacctgggtgtcatggcgggcacctgcaatcccagctactcaggaggctgaggcagaagaatcacttgaacctggaatggggaggttgcagtgagccgagattgcatcactgcactctagcctgggtgacaagagtgaaactccatcttgaaaaaaaaaaccaaaaaaaaaaaaacaaaaacaaaacaaaaaaaaccacagctcagcctctcagcaaccttttcctaactggcctccaggtcaaaggcagccagtctttagagtttctttcccctctgggttccagtcagtcttactcactctttgatgctttttccattttttatgtatttttcccagattttaaaatttctagtgagagtatcggtctcaggcatctagtataccattatcaaagtggaacctcccactcttggcttattcatgttccacagaaccgtagtccataacttcaatgtacaaaagataaaaccccataggtgtgaaaagacttcctcaaacttacatgattagtggtaatgccaggtttagtctgagctcaagattaataactaccaaacttcactggcataaaacctgactgcaagagtttttgttttacttttttttttttttttttgagacggagtcttgctctgtcgcccccaggctagagtgcgtggcacaatctaggctcactgcaacctctgcctccctggtaccagcgattctcctgcctcagcctcctgagtagctgggattacaggcacctgccaccgtgcctggctaatttttgtatttttagtagagacagggtttcaccatcttggccaggctggtcttgaactcctgacctcgtgatccacccacctcagcctcccaaagtgctgggattataggcgtgagccactgtgcccagccttgttttactttttaacctaaggtaaggggagggcaatcttgccaaaagatcagaggatggaggcaataatcttacaattcagtttcctctaccacacctgacctatggggaagtaggggaagagatctcagatacccaatggtctgatggggaatggaagaatgcagtcctccccattcccaagtcatatattactgatacttccatcatcagttatcccttaaccttctatatatatatatatatatatatatatatatatatatatatatataatttttttttcttttgagacagggtttcactttgtctcccaggctggagtgcagcggcgcaatcacagctcactggagccttgacttcttgggctcaagtggtcctcctgcctcagcctcccatgtagctgggactacaggcccacaccaccatgcctggctaatttttaaatttttcgtagagacaaggtctccctatgttgccaggctaaaaccttttaatatttcttgtttttttgagatgcagtttcgctcttgttgcccaggctgtagtgcaatggcatgatctcagccacttttaatatttcttaacatctgtagtaactgaaccaaacttcaaattcctctagatcacaactcttgccctggaaaaccaagaagttgttttcagccagcttcttcctcaaaaaaacaaacgccaacacactctcacaacaaagaccacgccatttatttacaaaggccagtgtgggagctgggggaggcagggagggaaagccacacagacatcttctctggactgcttgggaccctttcccacttggagcaaactctgttcctcttgccgtcatattctcagccatggggtcggtcctccaagcagctgggccaagtaggagagggaagaggtgatatgagcctcctctgtgctctgacagagaaatgtccaattccagatcaaaggcatcattgccaccctctcctctccttcctcaaagaaaactttctggcctggagggaaatagttaagaactgaaaggccaggggctctggaggaaaaaaaccctctactattcccacaaggcagtgaggggtgataagggtgctagtcacagccctgacagcttcagaaagggtacccacattacctctgggttacccagcatccagagccccaagggacctagctctcccggatatatattcctgcaatggactgacctttttacccacttgtctctggtggtgggagagcactctgaaccagaaaccaacaaggaatccacttcccacccaacttaagagtgtatgcacacatgtggatacacatgcacctccccactactcacacagaccccaacccccttcatgtcttttgaggggggctcaaactactggtgcctggggacacaagcaagacctgggtccatggaaatgtgtgtgtgtgtgcatataagcacatatgcttgaggaactaaagccaatatgaccccttgtggggcgtggcgcttagcttcattgggctccttttttcagtttaaattccattagcatctctaagtctcttctgccagctcgggcctggattcttctgcctaaaagagctatgagtgcttctgctccccactgttaattccaacttccaagccttttactcaggctgtctcccccattcccttcctccgaataatctcattccctcctctttcacacgaatttcctctgggctgctccagcgtttgttaattcctgtccagagagctgtctcatctccctcttcagacagggagaacaggcatcttcctccttaccctggaatttccaacagttcccaccaaaaagtgctgaatgaaccagaataggggccgagaaggaaaattaccacctgtttcacctgctcctccttcagagcaagaaattctagcattggttgggctaggggttggggggtagggagaaaaagaaggaagagagttaccaaaagtaaacataagacaaaaccctagtggtatagatggaagactatgttccagtaaaccagagagctggttcctccctcgactctgcacagccactgaaagtttaaagattgcaaaagtggtgtggggcaaggaggtagagtcaatcaatgaaactgtgaaaactgtttaagtagcactgctcaaggagaccaggagagaagagtctgttagagacgtagcagtaaaaccataattctcagacagagctaaggggttggagcccatgcctctaaagtcaccctgctgtttggaaaggatgagggagaagacggaagggaggacaagctgcagagggtaaggattgacagaagaaccgaatgctgacatcgagggaggggagaggcaggaggcatgggccgagggattaggagagctgggagcccagcagtctctcgatagctgcgttgatgtcccctcctgtggcaatcagggcctgcaggttagcctcacgattgatgaagcccatggagttgagctgctccagctgctgctgaaatctcacttctggcgtctgcacctggaggggacaggccttgtgaagtgggcacaggaccaatcttgggggccctatttgaattaagggtttctaagaccagcaggtcttctctaatatcctcagagtcaatcaggagggcagggaagatgagctgcaaatgggggcccaggagcctaggtcccaagtcctaaataactgtgtaatggccgggtacggtggctcacgcctgtaatcccagcactttaggaggctgaggcgggcggatcacgaggtcagaagatcgagaccatcctggctaacacggcgaaaccccatctctactaaaaatacaaaaaattcgctgggtgtggtggtgggcgccctgtagtcccagctactcaggaggctgaggcaggagaatggcgtgaatccgggaggcggagcttgcagtgaggcgagatcgcgccactgcactccagcctgggcaacagagcgagactctgtctcaaaaaacaaaaacaaaaaaacaaacaaacaaaactgtgtaataatatggcaggcggatatcttttttagattttcaagataactgataggcctagatcagcatatattcctcattactttccataaacactggagatgttaacaggcactccaaaagccaaatgttctatggtcaaataagatgcatactaagcatgacctccaaggcccctcctaatagtcatcacacgtacagccatatgaaaggctagagaagggtcccagttaagaagctatttaattttgtttcactgatcaacagttatttataaaagagaagtatttcctttttttttgagacagggtcttgcacccaggctggaatatagtggcagaatcatagctcactgcagcctctatctcctgggctcaggtgatccttctctctgagcctcctgagtagctggggctacaggtgtgtaccaccttgcccagccaattaaaaaaaaatttttttttggctgggcatagtggctcatgcctataatcccagcactttgggaggccaagatgggcagtttgcctgaggtcaggagttcaagaccaggctggccaacatggcgaaaccccatgtctactaaaaacacaaaaaattacccaggtgtggtggcgcatgcctgtagtcccaactacttgggaggctgaggcagaagaatcacttgaatccgggaggcggaggtgcagtgagctgaaattgcgccactgcactccagcctggaagacagagtacatcttaaaaaaacaaaagtgcgtggtggctcatgcctgtaatcccagcactttgggaggctgaggcaggtggatcacttgaggtcaggagttcgagaccagactggccaacatggcgataccccgagactaaagatacaaaacttagttgggcatggtgacaggagcctgtagtctcagctactcaggaggctgaggcaggagaatcgcttgaacccgggaggcggaggttgcagtgagccgagactgtgccataacactccagcatgggggacagagtgagactccatctcaaaaaaataaaaataaaataaaaaataaagaaaaaaatttttttagcagagaaagggtcttgctatgttgcccaggctggtctcaagtgatcctcctgccttggcctctctaactgctgggattacaggcatgagccactgcactaggtcttcttcttttttttttttttttgagacggagtctcgctctgtcacccaggctggatgcagtggcatgatctgcctcccgggttgaagcgattctcttgcctcagcctcctgaatagctgggattacaggtgcatgccaccaagcccggctaatttttgtatttttagtagagacgtggtttcaccatgttggccaggtgggttttgaactcctggcctcaagtgatacacccgccttggcctcccaaaatgttgggattacaggcatgagccaccatgcccagcttgcactaagactttttttaaaagaaaaaaatttttacagactgggtctccccgcgttgcccaggctggtctcgaactcctggcctcaagcagtcccctgccttggcctcccaaagcactgggattacaggcatgagccacactcctggcctggcttttttttttttttttttttttgagatggagtttcactcttgttgcccaggctggagtaaaatggcacgatctcagctcactacaacctctgcctcccaggttcaagtgactctcctgcctcaacctctcgagtagctgggatgataggcatgcgccacgacacccagctaattttgtatttttagtagagacggggtttctccacgttggtcaggctggtcttgaactcctgacctcaggtgatctgcctgcctcggcctcccaaattgctgggattacagaagtgagccaccgcctggctagcttggcttttcattcttgtcattcctctaattatctcctgtaaatgtttgcccaaggggtatttggaaagcacaagccttgattatgaacaaaagactcttatagtggccgggtgcggtggctgacgccagtaatcccagcactttgggagaccgaggcaggtggatcacgaggtcaggcgatcgagaccatcctggctaacatggtgaaaccccgtctctactaaaaatacaaaaaattagccgggcgtggtggtgggcgcctttagtcccagctactcgggaggctgaggcaggagaatggcctaaacccaggaggcggagcttgcagtgagctgagatccggccactgcactccagcctgggcgacagagcgagactccgtctcaaaaaaaaaaaaaaaaaaaaaaaagactcttatagctagaaagagtccagcaagcaccgtccacctggtgttgaaaggaacaatgttcgatccagagaaaagacaggacttgcctggggtcacagagaaagtcagtcactaaggccccctgacttgcagtataaaagccctttctggacgggtgtggtggctcacgcctataatcccagcactttgggagcccgaggcaggcagatcacctaaggtcaggagttcgagaccagcctggacaacatggtgaaaccccatctctactaacaatacaaaaaaattagccgggtgtggtggcgcgtgcctgtaatcccagctactcgggaggttgaggcaggagaatggcttgaacctgggaggcagaggttgcgccattgcactccagcctgggcaacaagagcaaaactctgtctcaaaaaaaaaaaaagaaagccctttccagtgctccttgttgcttcttatcacagtccacacattttttttttttttttttttttgagatggagtctcgctctgtcacccaggctggagtgcagtggcgccatcttggctcactgcaagctccacctcccgagttcaccccattctcctgcgtcagcctcctgagtagctgggactgcaggcacctgccaccacgcctggctaattttttttttttgtattttttagtagagatggggtttcaccgtgttagccaggatggtctcgatcttctgacctcgtgatccgcccgcctcagcctcccaaagtgctgggattacaggcgtgagccaccgcgcccagccagtccacagaatttaacttgggttgcacctggactggacaccacctagtttagctctctcgtgccttgcacaaagctgggtaaacatacattttggttgaatggcttttccagatgagtcacagaggtcagagaaaggttaagaggctcactcgaggtaggtcatccctgcccctcctgccagcccctggccttgactttcccagggctttggttacctcgcagaatccccctccccagagtctcagagatgggggctgctttaattatcaaaaggatcctttgatataagcagaaatggtatagtgtaaattctggaggtggaatgcctgggtttgagtcttggcttcattatctactagctatgtaagtgagtaagccacttaacctttccgggcctcagttttccccatctttaacacagaaataataataatagctttctcatgaggctattgtgaggaatgtggtaaatgagtcgtaaatgagctccaaaatctaaagcatttagaacagtatgtagtgcacgggtaagtaccattactcttctcatctctatttcacatctgcacaaactgaactcagggagcatcagtaacctgcccaaggctagcaagtggcagaacaggacctgactcccaagcttgccctactgcctctattctattgcttcccttgaaacctcccaggatcaaagtggtgctcccagcacctgcccccactgcctcatgtacctgtgagtttccacttccagccaaaagctggatcatctgctgcatgagttgctgctgggcgctggaagcccctgttggagaagatgtggctggcgtggctggtgaggaagtgggggcctcgggcgtagaccctgcgttgctgcctgctgagggtgctggggtccgggatatcccaaaggagccaaggctgtaggcaagagagaccaagaggtaggagatggcatccaagaaagggatgagaatgtgagatccagaaggaaaagcagttggaagaaacaggaaaacagaccctcagagacacaaaggatgctgagagagtggcagagagaagagttgaaggggagaagttgctagaaccttgctgccctcctgcccccctaccctcacctgggtaccagcccaggggcctcggtctgcaaggtctgtagtccctgctggatctgcagcaatgcctgcatggctcggggattggtaaggatggagagtgactctgggttctgcatctggtgggaaataagcagagaaaggcatcaagaggtggcaggaaagaggagacaacctcaactaggagtccagagtcaagctctgccccaacttcatttccacccattgggcttcagggactaccccttgccctcaacctccacccatctaggctcctcactcacctgctgcaggaagactgggagctgcaggcggagctgctcctgcagttgggggttccccgcgaagagcggcacattcaccatcatctgccagggtgaaggtagcagggggagacctgggccttttcaccctaagaattcccccacagcctcagactccctgggcaccccctaccactgcaggaaatctggccagcttctccggggatctcaaagtatcctgaaggcctaagtgggacagtgagaggaaatggaactatgctctgggtaatgaagagtatgaggagtcagcctgctcagccctgggtctgatgatgatgaggacagctaacatttccaggtatacagaacttactctgtcacacgccatgttctaagcacttaacgtgtattaactcatttaatcctcacaactataggaggtaggaactattgttattatcatcttacagataaagaaactgggaggctaaataacttgcttaactcacacagctgggaagcagcagagcttgggatgcaaacccaggcagtctggctccacagtgttttgaccacaagaaactgcccccaaccaagaggaactctctccccaacaatactctcctcatgctggtttcatacctgagcagcaaagtcggggttctgggcaagcgtctgcatcatgctgcgcatgtagggtgctgagatcacattctgcatcagctgggggttctcagagatctgctggaggagggcttgcatttctgggctattgaacatccctaggacaaggcggaaaaaaagaaaacaggagagaaagggtccagatggaaaccgaaggcctcacttcaatctaccttacttcagacaccgaatgactacaaaactcagaaaagcaatggtccagtgggcaccctaggattgtggcatgagtccaagtctctcccaagtccaaggtcatcttgccctgctttggcctggccccttttccatttacttgataaggacaagccagctaggaactgggtctgatttatgcctctctggactgttcctgccataagctcaaattatgtccaatttggaaagaaatgattaaatatcatctagatcaaacttgtcttagcagcagagaccctttcctcatgctaaatctcactcagaaaccaagtgtgttaatggtctggctggagctggggcaggagggctgcagcctctcccattgggtccttcctcatcctggagatgaagacctttccaggatgcaggagcacaattttaaaatcatggatcaagttccagtccttactttacaaataaggaaactaaaacacacagagggaaggaactttcccaatcaagatatcccccagagtgcagagaaattagagcatctgctgaagacatcccccaggccatgtgtacagtcatagtccagataaatggagcatcctctagggttgtgcagtgcataacctgttcttctgtacatggcaagccctgcacatccctttcccccagcctcacatctgcctctccccaggtctgccttgattcctctccagccccctctccccacagcagtctgaaccttttacactggataataccagaggtgctcatggagcttaggaagtggggcctggtttactcatgagctattacttaggtcactcctagggatatcaggacatggccagaaccagccctcacccggccactatcccagacggcagagccccctctgtggcctcgatagtctcacctctgtcttcaaaatcctggagcagtatgaaccccattcagtcctgggacagaggggctgccctggtgaccccactaagctccttccatcctaggacatacctgaccccaggctagccgcattgatcccaaaggggttcgagactgtcgggtgcacctggctggtccccgatcctccggtgccctccccaccggacccgggggcctgggaggtggggggcgaggggctccaggggttagggaggggctctcgattctcagtccgcagaggctgggaggatgagctgtcggagttcccggccagggaagagaagggattgttgccaaactgggaggagggaaaggttttgggttaaggactgaaacaaatcagggacaagggctaggcccattctctcctctcacttaatagcctccccttccccagaaaagggagagagatctaagaccttagaggtcctcagttcagttctttgccccacaatggatagctccttccttgctccatagggtgggagctagctgatgctagtgactggataactgaacctctcagataattggaaacttcccatccccccggtggctttcaatatttggtctctaatcatctcctatgtaacccaccgcactttacacacagttttcccattgtgtagccaaatatttgtgttcctgtacctcaaggggcagaggcaatgtcagatttgcctgtgcacccccagccccgacactagtaggtgctcaataactaactactggcttaatgggagtgggctgtcaaacctggctctctacttgaaccccgatcttccctttccccagcctccttggactaatcctaactccccagaacctttccctcactccccaggtcccctacctggcattctctgtccatccaggcacaccacagtggcggcccctagcagaacacacctccagcagaatatgccctctctaggttttcccctcctgctccaaaccctacctctacacactggctacttcagatggacaggcctcagtttacttctggtcccccttgccctaccatgctcctcactgtgctccccaggatatctcaggtccataccccatgggatggtgtgcttcccaaaggcaacaccggaacctcctcccctccagcacctagcacagagctctggctgagggagtcccagactcagttttccctactcagcctttcttgtggtctaagagctcagcagctctctttcctgagttcccaggtggtcctacctcagcccctccccaccgtagggtttcatattgagctgcttttcctgttcattgaaagtgggtcatggggaccggggctaaccaaggattctcctactctgagctgtttccttcacctcaccagatcctgttcagataacagagctcacaggccagggttcatgcaccatggtttcagcctctgtgcctgtttcagatttcttgttctgatacttgcctagcacctcaccccaccttgttctgggctcgctttattcttcctggtacactctaaggacgaaatctcttttcctgaactacccacagtgataacaaccatcatttattgagcacctactatgtgcctgacacatttattctaatgcttataatactcctctaatacaacagttctcaaagtgtggtcctgggacccctgcaagcattaaaactgttttcataattctaagacatgaatttgtctttttcactcttattctctcatgaggatacagtggagttttccaaagtctacatgacatgtgacattgcaaactgaatgcagatctgagaaccagctgtcttgtagtaagctagacatcaaagagaactacaaaaatgtaaaacaagtccatactttcctctacagttttgtttgttttggaaaataaagttatttttcaaaataatgttatttatgttaacttgtaataattttttttttttgagatggagtctcgttttgctgcccaggttggagtgcaaaggcacaatctcggctcactgcaacctccacctccagggttcaagcaattctcttgcctcagcctcctgagaagctgggatgacaggcacccaccaccacacctggctaagttttgtatttttagtagagatggggtttcgccatgttggccaggctggtctcaaactcctgacctcaggtgatccacctgcctcagcctcccaaaatgctgagattataggcatgcgccactacgctccaccaacttgtaataaattgtcatttttaaatgaaacaaatattttaaaagtttgtcagttttaggccgggcacggtggctcacgcctataatcccagcactttgggaggccgaggtgggtggatcacctgaggtcaggagttcgagaccagcctggccaacatggtgaaaccccgtctctactaataatacaaaaaaaaaaaaaaaatagctgggcatggtggcgggcgcctgtggtcccagctactcgggaggctgaggcaggagaatcacttgaacccgggaggcggaggttgcagtgagctgagatcacgccattgcactccagcctgggcaacgagtgaaacttcgtctcaaaaaaacaaaacaaaccaaaaacacaaaacatttttaaaggttgtattaaaaaaaaaaaaagcagccaagtgcagtggctcacacctgtaatcccagcactttgggaggccgaggcaggcagatgacaaggtcaggagttcgagaccagcctggccaatatggtgaaaccctgtgtctgctaaaaaatacaaaacttagccaggcgtggtggtgcaagcctgcagtcccggctactcagaaagctgaggcaggagactcgcttgaacccaggaggtggaggttgcagtgagctgagatcgcgccattgcactccagcctgggcgaaacagtgagactctgtctcaaaacaaaagcaagttaaaataataagaccagcatggtaccacctcatatttaaaaatatgataatatatagacgtttatagacatatacataggtaataaaagaatcagaatgataaaccccaacttcaacttcagcatactagttacctctggaaagaaaaagaataggagaggggaggggtttgtaaaggctacaactctacctatgtcttatttgcaaatattaaatatgtctaggaaaataaacaagatactaacaacattagttaccactgaggtagaaaagagctggctgggagatggaaacagagggatcccttctgtaaacctttttttagcctgtatacttttccatacttttttggaatacccttttgtttactttgtgtaacttgtgaatttttttttttttttttttgagatggagtctcactctgtcgcccaggctagagtgcagtggcacgatcttggctcactgcaacctctgcctcccgggttcaagcgattctcctgcctcagcctcccaaatagctgggactacaggcatgtgccatcatgcccggctaattttttgtatttttagtagagatggggtttcaccattttagccaggatggtctcgatctcctgacctcgtgatccgcccacctcagcctcccaaagtgctgggattacaggtgtcagccactgcgcctggccaacttttgcattttcaaacatacaaacatagaatgtgtttaatgtaaaattaaatttttaaaaagaaccatggccaggcgcggtggctcactcctgtaatctcagcacttttggaggccaaggtgggcggatcatgaggtcaggagatcaagatcatcctggctaacatggtgaaaccccatctctactaaaaatataaaaagttagccgggcgtggtggcatgtacctgtagtcttagccaccagggagaaggcaggagaattgcttgaacccgggaggcggaggttacagtgagccgagattgcgccactgcattccagcctgggcgatagagcgagactccatctcaaaaaaaaaaaaaaaaaagaaagaaagaaagaaccaaaagggcactgaaattatatatggcaacatgttagggcaacattgattaaaaacaaaaaaaaagaatgttacatttttatctatttttttgtgtgtacttgaataggattcataaagcatttttaaaagtgtataatcctggggcccaaccccagaaatggattcaataagtagctcaaaggtggggaccaggattctcattatcaacaaggtccccaggtgattctgatgcaggtgatccatggaccatacttgagacatgctgtatcagggctggcgtctgacctcaggcctgccacgtgacctttgagcccctggtacaagaagtttgtcaggatgtcaagttccttggatgctatgcctcaaccacttccacaaggacctctgcttatatttgtccatgccaaaatggaccatccccggatatgtactgttgagaactgccttcaagccaaggcccacccctcaggggactggggaaagaaagaagagcaggcccaggtttgcctggggtgggggtagggaatctcgagcccagacagcccaacccactaccctggcccttgatcccacctgttcccgggcagcactgaacatgggctcctggatgtccgtgtacatgcggcggagggcattataccctccagggatgctctcaaggttgctcagggcccggtcctggttccgcatcatctcttgcatcatggctggattccgagcaagctccattgtctgatcaagggagagagacaaaatgggccccggaaccaggggagcaccaacctaggaaaagggtgggccttgaggaaggggggtctgtatcaggatcaggaccagggcccaggaactgccccacagtgacagggagtagagtaaactggacttccttcctctactgtaatcttggctccaagcccgcctccctgtgggtattttggttggctttttctagtggaggacaatgatcccagctgaagtgagggcagcagcttccctcccttaggctcagagtgtccaaagaagtgtcagggtgcacaaggaaactgagtcagaagagacacagaaagaaaggggaggaggcagaagagaaaattaacatctactgagaacctactgtatatgggcacagggccaagtagcttacggaattcaagtcatgtaatctccacaataaccatctcaggtgtttatttctgtccctattttgcagatgagcaaataggctcagagatgttaattgacttgctgccctgggacacacagtcactgagtggtgaagacagtgttcaaagccaggttggttggtctgtccaagaccatactgtgattcctggtaaatgactgcaagttggggaaggaaagcgttcaagctggaataaagctactgacaccctgtaattcccacccccaagtctttgctctgcctgaaccttgagaaacactgaagatgggggctttcttctatggagccaatggcacaatctcaataaggggtggctatgtcaaccccgggggagttcatcacagaaaaataagtataactacttgttcccattcaacttggaataccttccctctccttcccaaatgtgctccacacttgccttttctaagactcctttataactgatatgcccagcttcccagaactctgatctcttgttccgtaattcattcattcaataaatatttactgcatgactaccacgcaccaggcactgttctagacagtgaacaaaacactcacaagtccttgaccttacataaattatcttctggtgagtccagcactggtgtccacagccctgctgggaagatcatctaccttggtcctctggtggagcggaccatgagctggaactcccaaagagcaacatcacaacagtctcccctggttctccattcccaactgggccctgcccagccacagtgctccccaaacaacctactatctttcactcccaggcctttatatttgctgtccctcagccctgaatgttcttctttctttccccctggttcgtcttcctcctttgggtctcagctcggtgacatttcttaaggcctcctctaagccttagggtagggtcaggagctcttctctatgctcctagaggatcccatgattatccttctgatagcaatggccacattgtattctaattgccggtttacttgtcctacttccctttgacacctggaattcctgaaaagctaggcctgtcttttcatccctgtacctccagtgttcaaaactgctgaatacacgaatgaacaaatcaatgtaggacaaagtaggaaaggctgggcagggcacggctgggcaccagtgtcctccagctctccagccctctcatactcacctgcctcatgagttcagggttattgagcatgtggctgatctcagggttccgctccatcaactgctgcatctgggggttggccataatcatgtgacgcatcagatcagggttagacatcatatcctggaccagggggttctccatgatctgtgacagcatctcaggattggacatcagctgccgctgcatctgctgctgcagctccatgaagttggcagagcccaggcctaggctgcccagccccaggatgcccccaaagccagctgtgggaagggggcagggtcacagtctgccacaagaacagtgtcctcacttagccagagccactgaattcagatctccaggacacgccccaaatgcttctcacatgtccctcttcctgtcattcccacagcccggccctgatccactgctggcaaaaaaatgtgagcctactagactgaggctgtgccaaacatagaactgagcagagagaaggcaaccagcaatggtctgttgaatgagtggcccatgtggctactgctggatccaacttttccccagactcacagggtcttccattccctttacctagggttccccacatccccaaccccatttctcccctcactcctaacccttagccatggtccccacctctgagaactcctcagactagtttcttccccagcttgactcaagtatcaatgtctggaactctgtcatggggtcccctatccccatcagaccaggagcaggaactcctgtttctccctcctcttggctttccccaactccccaaccccaaacaagattgtgctctcctctctgagggcttacagagtatggacgcagtagcactgggggatccctccccagcccccggagagggccccccaccactgctcctccggcttccactgccagcatctgaagaggcactgccagaggtggagggctgggcaggggtggcgggtgaagcaggcgtggtggagggtgctgaggcagggtcaggtgtggagggggaagaagcagtggcagcagctggatcttgagccctgaggacagagaaaggagaatcctgttggagtgagcactagaagagggaaggtaccgtgacaatctctgtgcttgctatgggacaactattttaacccaagacccctcctgagcagtcctgaggctggagtggggtgatggcgggagggcagtcagtaaaccagcagagggagaaaggagctagtattatctgtcttcagggcattctgggaatggtaaatcaggttcccttcccctagagatgagatcatattcatccaggagctacctgcctgggcctcagcttaggccctctgggtacagttaagcaatgagtgagaaagtatcagatggggaggcccaatcagaagctggatctgctctgctcctgaacttacttctgaggggtcttgatgaccagatggacagtgagcccgtccttgattccgtgctggttcagtgtgtccccatccttgaggatcttgcctgcgaagatcaggaccagctgatcctgctgagccttaaacctccgggagatttcctctttgaactgtgatcaagaggcagaggtcactgtggaggctgcctggactccccctaccagggaccctgactctttttcaacaccttctgcactctcttgctctcatctctagtcatgggaagtcctttctgtagtctcgacgccattcctccagctgcaataagcatctcctttcttaacaaaggagatgaaccagtgagaggctcttctctcagctccatcccagagtctcccaccctagaaagcccctgctgctatctgcctcccagcttcagtccctccacctagttctctgtaaggcagagcagcctcccatcccaactccttcaacagctttggaccttcagccttctgagacccaattttctctcctctctattcccagtattctcttaacaactacaacaaatagatgccagttattgagcactacctattcaccagttaaagatatagtatattgttattttcattttattattatttttatcttgagatggagtctcgctctgtagcccaggctggagtgcagaggtgcgatcttggctcactgtaacctccatcttccgggttcaagtgattctcctgcttcagcctcccgagtgtctgggactacaggcacacaccaccatgcctggctaattgtatttttagtagagacggggtttcaccatgttggccaggctggtcttgaactcgtgacctcaggtgatccaccagactcagactcccaaagtgctgggattacaggtgtgagccaccacgcccagccgtatctccattttaaagatgagaaaactgaggatcagcgaggtaaggtaacttgccccaggcagaccagaactcaggtcttgacaccaaagtccaggctcttaactaaacacactgcctctcaatgagagccgttttcaaattcagctttgtagggaacatacagtatttaaattctgaaatttagtaattctatgtggttagggagggagcaaggatggagttagacttcccaaattctaccagcccctccaaaacacaacacaaaacaaaacacaacacacactttaagtaaaaacagtgcacttgttaagcagaggctgcttccagatccctctcttccaaccagatggcctatcttaagccccgcctatgtgaaattatggagcggccacagggggtggcgaacacaggcaacagtccgtcattcaacaagattttattgagcacctactgcacaccgtgtaaatctcagaagagctgagaaccaaatgtaaccacgtcgatttgaaagagtgggaaggatctgggcacagggaaatcctcccccgacagccccgtcgctcagagaacactgggcgttctctgaggcacagagtaggcgccggcgctctccgcctgcccccggcccgttctctcagttagcacctagcccgggcccccactccggcacactcccctcaaacccagggtccttcccccttcccggtgcaaggtgtcccctcctcactctccaccacgcccccaggccacaaggcaaaacccgcccctcaacacgcgccacgctcccccagatctcccctcgcagggcgccccctacccgcctctccttgccttcagctcctcggagtcccagccggcccccgccctcctctccggggccctccgggacgccggaccgtcagagaggccccccatctcttcgcagacccctcctccgcgctccccccgccccccgcctgctgtactacctccttgaccgaggctcgatcgcagatcacaatttcctccttgtccttgggggtcttgacggtgacccgaatggggggcctcgtctcggccccgctcggctccgccatgccgccgccgccacccggccgcccgccagcccgcccggctcctcctcctccccgcccgcccggccggcccggctcggcttctgcgcctccaacactcccctctctccacctctcccctcccctcccctcccctcctctctcctcccctcccctccccgaggcttcaccgccccctccggaccagccgcagccacagcgccccgggcggaccgggggggccactgcagcggggtccgcccagggccaagccccaggtccggagcccggccagggtctcgccaggcgggggcccctggggggcctctgggagggggaaggggcgtgcccttcattgcgggggcgagggcggactgccccgggagaccgcgacccaacgctgcccgcccgagccgtgccgcggtcccctccagcccaaagcctccccgccccctccgcggctaactcggctccgggacaaaggactttctgtgtcgccgctttatctccgttccctgtgataacttggtctttcttggaagcccaagtcccttccaggccaggggactttcccgacttggaggttgggttttcccaccaagcacgtccacctaggttctcagctctgggactgaccctatagccccgagggtcgcggcctgaatggtctattaagaacggttccagggagctgggttttggctgcgtggcctttcagagccttggtttcctcaagataataataatagtacctctcgcctcatcgcacagaattgtgcataacggagaaaactgttttgaaagtaaccaaaggcgtgcctgacaaatatgaggatgtagtataattattgaatcgtggactgccaagcggacacgttgattcctttctccccgaaggggttaaatgtccttccagcgctgctgctgtcctttcactcccgttcttttccgccccccaacaaccgcgtggtcggcttggaaaggcgaactataattcccagggtgcctcgcgaggccacaaagaactacgattcccagagccccccgcggtggggcggggttgagtcggaaccacaatagccaggcgaagaaactacaactcccagggcgtcccggagcaggccaacgggactacgggaagcagcgggcagcggcccgcgggaggcacctcggagatctgggtgcaaaagcccagggttaggaaccgtaggcatgctgcgccccaaggctttgacccaggtgctaagccaagccaacactggaggcgtccagagcaccctgtgagtgcagaccacggacccgagcggcgagcgctgcagtggggcggcgcgcggctccctgagggaggggtggggaaggatcaccaggaagggaggaagcggcagagggggcagcggctggggataccggccgggaggtcccctgtcgaaaagggaagccggtgtgctgggtgcttagggcatgttccgggacacgctcaggccagagccttgctggatgtgcccttggtgggacttgggatggaaacccagacgttttactccccgctctgagcacatcgctatccctccccgcccctcaccaggctgctgaataacgagggatcactgctggcctactctggttacggggacactgacgcccgggtcaccgctgccatagccagtaacatctgggccgcctacgaccggaacgggaaccaagcgtttaatgaagacaatctcaaattcatcctcatggactgcatggtatggagaggggagccagacttcccctgtcccccaaaggggatcccaagggggcgacctggaccccatcctggatggttggaggggcagggacaggatctccggaagattactaagagttggtctgcagcagcatttgtaataggcaggaccctattcatcaagtggtggtgaggaaggatccctggacctgagaggtctgacttgggttctggtctcagccatccacttatcagttgtggaaccttgggtaagtcgcttaacctctctcagcttccttacctcatgtttaaggagaagacaataatttccctctccccgctcccctcatgggttgttgtgaaggtcagatgaaataatgggtataaacagtagaatgacgtgcaaacacaaagtgttgtcatcccagtttcaccgactcacagaaccatggcagtctccagaccctagtccaaccccttaagctttcaaagaaaggaaaatgaagtccagaaaggggaagtcaccattagattgtgaacttcttagtatctgttcggtcgacaagtatttaggtccttgcagtattctcaggactagggaaaaaatagcaaacagaaagacaaaacccccagccctaataaatcttacacagtgatacaatcacggctcactgcagcctcgacctccctgggctcaggtgatcctcctgccccagcctcctgagtagccgggactacagacatgcaccaccacacctcgctaatttttgcatttttccagagactgggttttgccatgttgcccaggctggtctcaaactcctggctcaagcgatctacccacgttggcctcccaaagtgctgggattacaggcgtgagtcactgtgcctggccacattttttaaaataagtaaaatatatagtatatattaggtattgaaaatgcaatggagagaaagcagggaagtgaaagagtatgagtttgttgggtgtatgtgtcagggacagtctcactgaaaaggtgacatttgatcaatgatctgaagaaaggtgggggacaagccatgtggttatctgagggaagaatattttggacagaacagcaagtaccaaggccctgaggcagaattatgcctgctcaaggatcaacagggttggttggtatggctggagttacgtgagatggaggagggtagtaggagatgaggtcagagaggcagggagtgcagtgcttggttcctggcatacaataaatacctagtaaaagtttgctgaacttacttttgtttttttcaaattggccagaaggtgaactctccaggaaggatcttcattgtaactcaactgcctactctcccctaccccctgcacaaccaatgccatttttagttcaacatatgactcctactggatgcctagagctggtgctatagggcaatagctttcaaacgttttgaccacaacccagccataagaaatacattttaaggggctgggcatggtggctcatgcctgtaatcccagcactttgggaggccgaggcgggcggatcacaaagtcaggtgttcaagaccagcctggccaacatggtgaaaccccatctctactaaaaatacaaaaattagctgggcatggtggtgcgtgcctgtaatcccagccactcaggaggctgaggcaggagaatcacttgaacccaggaggcagtggttgcagtgagccgagatcacgccactgcactccagcctgggcaacagagcaagactccatctcaaaaaaaaaaaaaaaaaaagaaatacattttaaggctgagcacagtgcctcactcctgtaatcccaacactttgggaggctgaggctggaggattatctgaggccaggagttcaagaccagccttggtgacctaataagaccccatctctacaaaaaaaattttaataaataaataaataggaaaaaattttttaagaaagacattttaagtcagagctcaacacacacatagacccactaaaacaaaagtcatgaaacaatacttttcctactacatgtaatatacttcattttttcttttttggtttttaatgctgatcaaccttcttaatttatctcctaactgtggggtcaaatctgcaatttgaaaaacattaccatgggaaaagaggagaaataccagttgggttaccactcccatgcccctctcagtgtctgtggggtgagctcacagtaataacatcactcatttggacaactgttggcagatatgaaatttcatggtattagcaccctcaccaactgggatgaggtagggattacagaaagaaaaactgaatttctgagagactaagtttcccagagtaacatggttagtaggtggctgtgctgaggctggaacctgggctcagaaccccatgttcagggctgtggccaaaagcttttccgctgaacttcctgctgtgcccagggcatgggaggaagatatagtctctctggggccagagaagcctttggggaaggagggtgctaagggtgccaagcagaacatcacatcccatcatatcacccccaccaggagggccgtgtagccatcacccgagtggccaaccttctgctgtgtatgtatgccaaggagaccgtgggctttggaatgctcaaggccaaggtgtgtatgtgcccatccctccatagccctgggcccagccttcgtgcttctacactgtgttcactcccaccaggaccctgtttctagagttctcatgtctactcagtccatttctggtgtgggccagctcccaagagcaggtgggggttgggggctggttgcttcctatggcactgggagcagacctggatttggggtccctaatgccaggctgtgtgcgggactgatctctgttctccctctgcaggcccaggctttggtgcagtacctggaggagcccctcacccaagtggcggcatcttaacggcattggtggaagctggggtcagaaaagagaaatgaccatttggaggggcggggcctcctagaagaaccttcttagacaatggggggaggatgggactttgttttttccaagaataaacttcaactcctgtcatgtgtcttggctactttcttggatgggaggaatcagagaagataggaagaagcaggcatcgcttctaggattcctcatgttctgcaaggatggacttctacccaccccttcaccatgaccttctgcgaacaatggttcttggcagttacgccaaatagtccttgtcctcaccaatggcatgacctcacctagaccctgctgctcagaacagagtcttacccacctcataggcaaaactgggagtgagctcagaggtgcaagggtctggtgggggttgtgttgcacagagaatataaaggccctgagaggttagtgtctatcatttcaggtttgggggcgtgcgtgccttttatttttttgagagggtctccctctgttgcccaggctgtaatgcagtgacacaatctcagctcactgcaggctcaagtgattccacctcagcctcccgagttgcctggattataggcacacaccatcatgcctggctaatttttgggtttttgttttttgtgttttttaggggttttttttgttgtttttgttgtttttggtagagatgaggtctcaatatgttgctcaggctgttctccaacttctgggctcaagccatcctcctgcctcccaaagtgctgggattacagatatgaaccacttcgactggccagtgagtgccttttctattcttggggttgggagggtgcccctaacagcctagaacaagctatccctttcttcttcttccaggtgtttatgtgcttacacagaccctccccagatcttgaagccctttgtagacaagaggcctttgctgtgaggcctcaggtcctgtacagggagtagaagtaacccagacctcccaaaggccttcatctccagaccctgctcctacactcagaccactcaccccagctgtctgtttctgccccaggtctctgcctacccaatatccttaaagcaggtctgtatagggagctaccagcccccttccccagtgccatataaaggaacccatcccagagaagtgggtaggtttcgagtcccagctccacccaagatgagaaacactgcccatcccaggccctgggctgtcaaggaagggcagaagttactgtggccatgatactcccacagctctgcattgcagcagggtgactggtgttctatcagcccctggtctaatatcccttactctggttcccccagtgtacccccctaccagctctgaaggaaaagcaggccaagtgggtttcttcctttttttttttttttgagatagaatctcttgctctgtcacccgggctggagtgcaatggcacaatcttggctcactgcaatctccgcctcccgagttcaagcaattctcctgcctcagcctcctgagtagctgggattacaggcgcgtgacaccatgcctagctaatttttgtatatttttagtagagacagggtttcaccatgttggtaaggctggtcttgaactcctgacctcgtgatccgctggcctcggcctcctaaagtgctgggattacaggtgggagccaccgcaccaggcctctttttttttttgagacggagtcttgctctgtcgcccaggctggagtgcagtggcgcgatctcggctcactgcaagctctgcctcctgggttcacgccattctcctgcctcagtctcccgagtagctgggactacaggcacctgccactacgcctggctaattttttgtatttttagtagagacacagtttcaccgtttctaccatagagccagagagggccccctcctgtttttttatctcttaccaagacctcctggggctcctcattccttcaggatggtctcgatctcctgaccttgtgatccgcccgcctcggcctcccaaagtgctggaattacaggtatgagccaccgcacccggccttttttttttttttttgagaagcagtctctgttgcccagactggagtgcagtggcacgatctcagcccactggaacctctgcctcccggcttcaagcaattctcctaccttggccgcccaagtagctgggattgcaggcgcccaccaccatgcccagctaattttttttttttttttttttagacggagtttcgctcttgttacccaggctggagtgcaagggcgcgatctcgactcaccacaacctccgcctcctgggttcaagcgattctcctgtctcagcctcccaagtagctgggtttacagccatgtgccaccacgcccagctaattttgtatttttttagtagaaacggggtttctccatgttggtcaggctggtctcaaactcccgacctcaggtgatccgcccacctcagcctcccaaagtgctgggattacaggcgtgagccaccgcgcctggcctcaagtgggtttctgaggggctatttcttgctcattagttgggggaccggccctcaccacagattccagaagcccagcaatgcacactcagccctcagtgggctgtctctgaaggtcctgtccctttttcgcttcccccccgctggagctgcttctcccgcttgcgggagcccaggctgagagcagacacccaacctgtcgaacctgtctgacgtcatcatctctccacccacctgggccccaggtctccagccaccccgctcttcctgttctcagcttccgtcctctctgcttccttacagcacccccacctgccagagctgatcctccctaggccctgcctaaccttgagttggcccccaatccctctggctgcagaagtccccttacccccaatgagaggaggggcaggaccagatcttttgagagctgagggttgagggcattgagccaacacacagatttgtcgcctctgtccccgaagacacctgcaccctccatgcggagccaagatggggaatggaactgaggaagattataactttgtcttcaagggtgagttgggttccctgaagcaagaggaagcctgagagacccagaaagagattgaatagagccagagagggccccctcctgtttttttatctcttaccaagacctcctggggctcctcattccttcagaaagaaagctgcagggagtgggggagggtctggttgcaggggcaaaagtcagggagcttctgagtatgctctactgtggtaaataatgatgttgattcctccttaagagtgctgagttaggctcctctgccccgttcctaatagaaacccaaatccctggtgtcagccagtgcagcacaagagatggaggtcagacttcagaaaggacttccctcttttatttttttttctgagacggagtcttgctctgtcgcccaggctggagtgcagtggtacaatctcagctcactgcaacctccacctcctgggttcaagcgattcttctgcctcggcctcccaagtagctgggactacaagcacctgccaccacgcccggcttatttttgtatttttaatagagacggggtttcaccatattggccaggatggtctggaactgacctcatgatccgcctacctcggcctcccaaagtgctgggattacaggcatgagccaccacacccggccaggacttctctcttgagaagaaagggaaaccagcaaacaagaggaagaaagtcatcttttctgggcaggtgtacagggaacgagagaaaggagagacacatcccattatagggtggggcaataaatacatagggaagacagaaaatatcatgaatttgctgcagagtctgatagaatccagaggactcctagggttgtagcctcgtctgcctggcccttggctgactcactggacctgcataccaggcactgggctcaactttgctgtccctggaagcatgcatgtatctttctagcccctgtgtttggtgcctttgctgttttccaaccccaccttcatacttcctttagggcagggtggactctccagccaccctaccccaatgcctctcccaacctcagcccggcccctcccttgagctgggactctcactccagaacccgcccttgagctggggaacctgtactactggcatcttttccaggaaggaaagggttagcaatagtctggggcaataatatgaggaactaccatttattgagcacttactatgtacctgccactacctcattaataccataacaatccccgaaagtcatattttattttgaggggcagtgtaacattgtggtcaggagccagactgggttcagatctcagccctgccacttacaagtattgcgggttggtcagccgggtgcagtggctcacgcctgtaatcctagcactttgggaggccgaggcggcgggatcacttaaggtctggagttccagaccagcctggccaacatggggaaaccctgtctctactaaaaattcaaaaattatctgggtgtggtggcacgtgcctgtaatcccagctactcgggaggctgagacaggagaatcacttgaacccaggaagcagaggttgcagtaagccgagactgtgccactgcactccagcctgggcaacagagcaagactctgtctaaaaaaaaaaaaaaaaaaaaaaaagtattgagggttgggttggggtccctagaagcagacgctgagaagaagttggggtgttcaatgtttgtttgttttttgagacggagtctcgctctgttgcccaggctggagtgcagtggagcgatcttggctcactgcaatctccgccttcctacaacctccgcctcctgggttcaagcgattctcctgcctcagcctcctgagtagctgggactacaggtgtgcaccaccacacccagctaatttttgtatttttagtagagacagggtttcatcatgttggctaggatggtctcgatctcttgaccttgtgatccgccctcctaggcctcccaaagtgctggtattacaggcgtgagccaccgcgcccagctcaatgtttttttacaaatcagcacctgtgaaaggaagggagaggaaacataattgggcagagggagaagtcaaacagcaacacaggctggacaaacctgggtcaagggcggggagctctgtgattgcctcaccttgcttgagcactgggtgtaggctgcccagaaaaggcatgacttccagtgaggccgctgtctgcaccagaggcagacgctgaaggagctgacagctggagcctgtctgcagcctgcactccctgcagcttggggcaagtccttccttgaaggctgatctggccagcacatctctgtgtttacaacactagccctgttatcttgggcaagtcatttgacctccaaagcgccttgtctgtaaaaacaggtaaaatagtaatgggattcatggcattcttatgaggattaaatgaggtaatatgtgtaaagcttttaacgacactgcctggcacatagtaagcattcagtacactgtaaacatgaaccattagtatctccactttacaactgaggcttagaggcaaagtagtttacaaaaggccacaaagtctgacttcaattcccttgccctaagcacctttgtggtatgacgctagggctgagagcccacccactgagagggatgagggagatgtgcccagtaggggagaggcaggaacacacacacacatatacacacacacacacgcatacacacacatcctcttacccacacatatccatattatttccagcttttccatactgtcctatgcaaataaggaatgtttaaatatatattttttatttttattttttgagacacaatttcactgtcacccaggctggagtgcagtgatgccatcacagttcattgcagccacaacctacggggctcaaacaatccttccacctcagcctcttgagtagctgggactacatgcatgtgccaccacacttggctaatttttttttctttttctttttttttttttgagtcggagtttcactctgtcacccaggctggagtgcagtaacacaaactcggctcactgcagcacccccagggctcaagcaatcctcccacctcagcctcccaagtagctgagactacagacacatgctaccatgcctggctaatttttgcattttttgtagagatggggtttcaccgtgttacccagggtggtctcaaacttgtgggctcaagagatactcccgccttggcctcccaaagttctgggattacaggcgtgaacctccacacccagccaaggaacttttaaagttggaggaggcctttataagttgtataagcaaggcaactgagactgagaaaaggtgagtcacttgttcaagttcacacagttagttagaagctgagcagggaccagagcccacaatatgtggctcccagtccttgggtgccagcctgcctttccagaaccactctgggtggcctcctctaattctgtgtgcttagttcagtgccagtgcaatttgtgggctctactcacatcagccccctacactctaccccagcccccagctcatccacatgggtaagactgggccctggatgctgcccaccagtctaaagggtcttcatggcccctcaggtggatccttgtctctgaaaacccaaaggcaaaaactctggcctgctaacaacaatcataccagtcatgatttttacacttactatatcctgggcaatgtctcacttacttcctacaataacccttaaggtagatactaatgtcttccccatttttcatatgaaaagaacagctcagattggttaaataacttgccgaaggacacatagctggtctaacacccaggcccatgctcttaaccatgcgggactgtccctccttagggacaactggaacctaacttcttacacacacatgagcacacatgccttcctctcacccacagatgtgtcaactgccaaactttctccttacccacactttgattcacacctctgttccttatgcaaacacacacacaccaaacctcccacttgtcctcccagctcatatatatagagacaagtgcaatgttctcatactccaagtcctagtccagaactgtgcaccccctgacctcccaccatccctgtccatattcacacacaacagtaatgtctccgcatgacactcataaagagcccacagatgtcactccctcaccagagatgcaggctgactctgcaaccatgtatcaacagaccaggctataacccgtcaagcccctttgtttgttttaaactcttggctttcctgcccaccaggacagatgcattatgcagagttgcagactccagtctcacaggagactccgttccctaatcttttttctgagctcagttccctttttctgctgggcagaccctccaagctcaggtggggttggagctgctctaccccatgctcagcccttatctctccactccttcagtggtgctgatcggcgaatcaggtgtggggaagaccaatctactctcccgattcacgcgcaatgagttcagccacgacagccgcaccaccatcggggttgagttctccacccgcactgtgatgttgggcaccgctgctgtcaaggctcagatctgggacacagctggcctggagcggtaccgagccatcacctcggcgtgagcccgggcctggggggctgctgggtggtgggagttctggggaagtcgaggaacacttctggaggagaagtgggggaggaggaggcaagggggctcagcagtgggctctggggggtggggatggagatcacagaagataaaaggtactgtaaacagaaacagcacaagccaggatatagtaacactgactagtactactaaaagcaggaatcattgccacttactaagcctttgctatgtgcccaggaagggacaagttactttacatttggcattttatgtaacccttaaagtaccacaggagtaaagtgctataattagttaatttctgtataaatacaaacaaggtgaaatcagggtggagctaggatgggggcgagctgcacggatcgagagcgccccctcacttccgcacaatgctctgcacttggcaactttcatctaaccacagaggaccaaaagctgaacccagcatctgcattttatgaagactcagaggacacacaggaggttaggcctcctgacaccacatccgaagtgtctcttaggccgggtgtgttggctcacacctgtaatcccagcactttgggaggccaaggtgggtggatcgcttgagctcatgaattcgagaccagcctgggcaacatggcaaaatcctgtctctaccaaaaatataaaaaattggccgggcttggtggtgcgtacctgtagtcccagatacttgagaagctaaggtgggaggatggcttgaacccgggaggcggaagttgcagtgagccgaaatcgccccactgcactccagcctgggtgacaaagcgatactgtgtctcaagaaaaaagtgtcagctgggcgcggtagctcacacctgtaatcccagcactttgggaggccgaggcgggcagatcacaaggtcaggagttcgagaccagcctggccaacagtgaaacccccgtctctactaaaaatacaaaaattagccaggcatggtggtgggtgcctgtaatcccaactactcgggaggctgagacaggagaatcactcgaacctgggaggtggaggttgcagtgagccaagatcatgccactgcactccagcctagcgacagagcaagactctgtctcaaaaaaaaaaaaaaaagaaaaagaaagtgtcttccagtcagtgtgaggcctaagcatgtgaaatggggtctgtttgtgtgtatatggggtggatagcacttgccagggggcaggaagcaagagtcaggggctttggttacacatgctcctcgttacctgatctcttatgagcctcagttgactcatcaatgaattgggagttagacatcactagtctgaagacatcccatccaactccaagagggagactggatgctttcagtgatgccttgaatggtcaggccagggactgctgcaagaggtaggcattcagctaatcctagaaagaaggccacgggagagaacaggccactgttaaggagccatgtgaggaagatcttgaaggtggcagagttggctaaagcccagatgtgcactggtggagagtaggggctaaaatcaggacgagaacctgagaaagtagaggggctggctgtgaggaagccaatagagattttagagcagggaggtgaaactttatttatttagttagttagttgagacaaattttcactcttgttgccgaggctggagtgcaatggagcgatctcagatcactgcaacttccgcttcccgagttcaagcaattctcctgcctcagccttccgagtagctgggattacaagcatgcgccatcatgcccggctaatttttgtatttttagtagagatggggtttctccatattggttaggctagtcttgaactcctcacctcaggtgatccacccgccttggcctcccaaagtgctgggattacaggcgtgagccaccgcgcctggccgagggaggtgaaactttacaggctccaagactagtgtccctggaaggcagaggagccttgggctgctctgttgggttctgggcccctggccgcaagtttctgtatttcctgatctctagtactctgatcccgggtgttccagcttgacggctctgctctgatgctgggtccaatgcctctgatcgtatctctgtccatccttctcattcccacccaggtactatcgtggtgcagtgggggccctcctggtgtttgacctaaccaagcaccagacctatgctgtggtggagcgatggctgaaggagctctatgaccatgctgaagccacgatcgtcgtcatgctcgtgggtaacaaaagtgacctcagccaggcccgggaagtgcccactgaggaggcccgaatgttcgctggtgagagcctgccactacccaggctgactcctccaagcttagcccacctttcccttgcagtctcccagcccctgcccccacccatagagcccctagcctggccttcctccatacagtcctctaccccatcccctcttcctcaggatttcccagcacttcccctttgggaccctgtgtctcccatgatgtcccaccacttgccctgagattgtctttattgattttttttttttttttttttttgagaccgggtctcaatctgttgcctaggctagagtgcagtggtgcgatctcggctcgctgcaacttccacctcttgggttcaagcaattctcatgcctcagcctcctgagtagctaagactacaggtgtgcgccaccatgcctggctaatttttgtatttttagtagagatggggtttcatcgtgttgaccaggctggtctcgaacccctgacctcaggtgatccagctgcctcggcctcccaaagttctgggattataggtgtgagccactgtgcccggcccgtagttaattttaaggcagccccaccctgtaatgctcaaagatcctatggagaggataggcttcccaggagttttctgagtttagaggcagcacaatatggtggttaagggtgttctggagtcccatggcccagtctcccatctgctcttggccagttactaaatgtgggacatggagcaatttccttattctttttctttttctttttttgagaggagtctcgctccgtcacccaggctggggtgcagtggcacgatcttggctcactgcaacctccacctcctgggttcaagcaattctctgcctcagcctcccgagtagctgggattacaggtgcccgccaccatgcctggctaatttttgtatttttagtggagacggggtttcaccatgttggccaagccggtcttgaactcctgacctcgtgatccacccacctcagcctcccaaagtgctgggattacaggcgtgagccaccgcacccagccccttatttgttttctttgtgtttctggattcagttttctaaatgaacctaccttgtaagttgttttaaggattaaatgatctgctacatgccaagagtttagcacatggcaaatgtatatagcaaacattaatattattattattattgcctttgactcccacaattaatggtgtgtttcccttcctggcagaaaacaatggactgctcttcctggagacctcagccctggactctaccaatgttgagctagcctttgagactgtcctgaaaggttagagcctacctttattctgcacccctattccatccccgtggcttctacaggcagcagtaggaatgcagacactcagccctcaccccagctaatttctcagctcctctgtgggtcctggcaccactgcctgtccccctcagtccctccccagtgcctcccactcagtctggagctcagggagggaacaggccacactccccatggggctgactcttggttccttctccacccaagtaagtagaagggacccctatgtccacacttcatttccttcctgcaaaacctcctgcaagtgtggccaccccccatgctcagaaggggcatgcagtatgtatgggggggttggggagaagggagcatgggctctaaatcttctggcctgatcactgccctctgccctcccagaaatctttgcgaaggtgtccaagcagagacagaacagcatccggaccaatgccatcactctgggcagtgcccaggctggacaggagcctggccctggggagaagagggcctgttgcatcagcctctgaccttggccagcaccacctgcccccactggctttttggtgccccttgtccccacttcagccccaggacctttccttgccctttggttccagatatcagactgttccctgttcacagcaccctcagggtcttaaggtcttcatgccctatcacaaatacctcttttatctgtccacccctcacagactaggaccctcaaataaagctgttttatatcaatgcctggtcattccactgcctcccgtctgttcctccctcttctccttgtctgtgcctccccttcaactttggcccctcctctgagtccctaatccccttcctctgtcctccccaccatacctactgcccctcagggccagctgcctctggagttctgtggtctggggacagtgccaaggggataggaggtgcctgcccttccctctgccaacccccagggcaggtgggggagggaggagagcatggaggggagggggtatatctggaaggcgagacaaaggaaaccatcggcgggcaccatctggtgctgagggccctggtgccaacaactgaggtcactccaatgccaggggcaaggggaggaggcagcgggagatacaaggggagaagagggagtgggggccagtcctgtaggtgtgtactggggaaggggtttttaagcctgagaggtgcaaggtccaagtcctccatccagtcttttttttttttgagatggagtctcactctgttgcccaggctggggtacagtggtgtgatctcggctcactgaaacctccacctctcgggttcaagcaattctccctgcctcagcctcagctgggattacaggtgcccgccaccacacttggctaatttttgtatttttagtagagacggggttttgccatgttggccaggctgctctcaaactcctgatctcaggtgatccgcctgcctcagcctcctaaagtgctaggattacaaacttgagcccttccagtcttcttcctgatcccaaagaagaaggatggattgaatctggtggggtaaatggggagggtccctgtctcttagctctctgccccctttccatggagcataggagatggctgtccaggtagcatctctgtcaccctgcctcaccttcccctgttcttttttttttttgagatggagtctcactctgttgcccaggctggagtgcagtggcgtgatctcagctcactgcaacttccgcctcctgggttcaagtgattttcctgcctcagcctcccgagtagctgggactataggcatgtgttaccatgcctggctaattttctgtatttttggtagagacagggtctcgctatgttgcccaggctggtcctgaactcctggccttaagcggtccatccacctcggcctcccagagttctgggattacaggcatgagccactgcgcccagtcaccttcccctgttcttcaggtcagggtggaacaaggcctgactgcacctccaaagaagagaagggagtaaatggagagaaaaggcaggggattagagcttggagactcaagcagagctatggagagctgaaagggggagcttaagggtggcaaggaactccagagacatccactactcacaggtgtgtagggagcccaaagctacactagaggaaaccccaagctgcaatccccacccagatcctcccactcaccccaagatggcacagacttacatgcagagaacgaagacagagccttaagtaatagtacttttaataaaattaagttcttaatagcacatttaatacattaaccctcccccttcttggtttctctgcattttgtgcaacatcactttgacttgattattcttgggtctgttttatttcccgcttttattttgcttttgaaatctttttccttggtggatttgtacgtgtcttcactagatgcctcaaattaagtctgaccacaatcctactctactttctacagtggagagaccatcctccctgccccagggctgtctccacccacccccccttccccacccgcaccctcgagtggggaaggggaagccctccccaccccagacgctaccatcccaaactagcggggtttctaggacaaaaagagcagggggaatctgtccctaggtggggcgagaagagtaaattgggtagagggagatgtgtttggggtctagggccagggagggggatggcagagtcattggtgtaatgaagcaggctcctcctgccaaaaggagagccaaggggcccctccaaccccttggataggaggggaaggcccagtgattgcaagctggggttggtagaaggcaagtgctttaaaaatgttgatttctcacacgcagaagccaagccctccagttttgtgtggggagggcaatgtgttcccaggccagggtacagtagatgacccctacctgaacacatatagatggaggtgaactggagcagagggtcagggttagggtcacccaaagtccctgtgcctttccccagcctctgtgcccatggggatgcctttctcccaggccttcaaggacagtgtttccactccactccgtgggaagtccttcttggaatctaacttttatgagacaagaaagcactttgcaagtaggtgaagaacgagtcagctttaaagaacaattactgagattgttactgctactgctgccatggaggtcaaagctaagtggaaagctggatgggaacaggggtaggggactgatcgcctcagtgctcttgaagctctgaaggtgagaagcgtgtgtgcatgtgtgtctgtttgtggaatgacttcccaggctcttaaatcaatctgtagagaagtggaccgaggtcacacttcaagaaggacttcctcagttaggcctgggggaagcaggcatgggagggtttgagctgggagccccaggaggggacataccacattggagtatgggctgcccaggtactaggggtgcaggtgaatgtgcttggcctcctctgctgcccccaacccagcccctgtcttattgagatgatcagtgtgcatcctttccaagaccctgggaaatgaacccctcatttctttgtcctacaatttaaaaatccaaggattctcagaatcaaccccagcagactggaagctcccaatcttaaactagcaacctgatccaaccctggtatctgaagattgggcaactcagggtggactcagccacttccctcctctatttatcttttccttacaacttttatacattctactggacccaggggccctcaatgctactaaactttaagctatcttaatattgtctactaagtaactagtaattgtttctttctctctctaggattatatgaaataaatttgaattattattattaataattattattttgtagtattcttttcttttaaacccctcggtttctctttttcttctctttctctcttgtttttggttaaaaaaaaatctagatctcttaaatctcacacatctctgagggttcctataggcctgctaggccttaattctggattccccctcctcacttgcccctgcgacagggcaggggaaagtggtgggggacaccccaggatcctcagtccttagtcctacagcttcttcctttcttgttaatccctttctttgtttggctctgccggctcccctgagggggagggggagaggggaggaggagtccatggagtgaaatccaatctactggaagggtcccaggagggaccgggttcccccagctcctctctccaccattcacccccgggatgctcccccaagaaaagcaaatgacattcctccccaaaaaaaaagtgggggaaaaaagcaacgtaaacccaaacatatattaaaaacactttttttttttaagatttaactctgaatacaaatgtatttttttcttcttctctccctacatatattctaaaccttctaaagtttttttatttttttaaggatcactttatcataaaataaaatatccttttcatataataaattacctaataaaaagtctttttttttcatattagcccaggttctttgctacatttatatggtaataaacgcctttattaaaatagaatattaaattataaagaactgctttttttttttttttttgctatttttgttttctctcctctgtgttggtcgcctgtctcgctccctctcatgctctctttctctcctctattttgtctctcactattcgtgttttgtgtttgtttctaggtttggctcaattggtaagggtgggattgaatttgctgagccccctagtgtaacagtcttctgcctttgtgggtaaagagtggagagggggagggggacgacagacagacatcccttcttcccacccccctccccacctgccccccggcaaccgagggtgcccatttggtttggtttctattgtacagacatctcaggatggctcacataggcgggaaggagggaagtcgtcacagggcagttttcttggctgtgacctccttccccacccctccctggctggtgttctggaggggaaggctgtggagaggtgttaattctcgacaggaggaaggagaggaggaaatcccctctgcacctccacctgctccatccaggaagaatgggactctggagctttaagtgctcgggtgatcactcagaacagtcccaccccactatttacaaggatctcctgggactcccatccctccatcctctcttggcccggccagcggaaccaggagggtggagagctggtggcagccccaaatgagcaggagggaagcagcaaagggggtgcaaggcctgtaacaatatgtgattctcagaataggccctgctgcccacctccccccagtcctgctttgccccaggctgacccctctttgaagacctggcttctcctcaaccacatcaggtgggacacagactccatgatttgcatggaggattcaagctaataaggattcaagctaataaggattcaataaaggttcaggtcaggttgagaggggtgcagggagtcgggcactgcatgggaggagcagctcttccctccaccagtctctcctcctgcctcacgccctttcctgctcctttaaatagcagacacactactctggcgcccccacttccacaaccagaaaatccagcccaagaactactccctaaatataatgcccatagtgatgaaggtgggggtttgaccctttaccccagtattagtcccctcctcacattttcactgagaatggggatacattccatcaataatttgagatgtttctttggaggagtgggggagagggcctccagatgcctgaagaggaatggagggaccatccaaatattcctccccctacttctccccagaaggatggtgtccccaaagctgggctggtaggggcaggggcagggggaagggaagaaagacaaagacaaggaacaagacagagctgggagtgacagccaccaaaagaaagcaaagcaaagagctggagggaaaggaaagagttgaggaaagggaagatcccaaaggaagggaagataggcggagagagtgaagggaaacactgcaggggacaggggcagagaggaggactcctctccagattcctctagcccagctttgtggggacagatggcttctgagcctttcagccacagaaacgattgacatgcttctctccccaacccctagaagatctatgcaacttctgataggactccaactcccttacactgctggaaactggtgacagtttcccaaacaggatatgggggtggggtgggaggtaaagggtcatgttaggaggtcggaggtcaggaccagagggcttagggattgcaaagagcacctctagatacaggtggtaattctccctctcccttttacccaccccctcctcggaagaaggggtggagtgacacacagcgggggaggtgggcagagggcgtcagaatgccttagtggccacctctggcaaaacaaaagtttctcttagctgcttccagatttaagggtgtgttgaggtatcagagttgtaactctagtaaaattttcagtctggccccctcccaatctttccaggacagggtgaccagaggctctgaaagtggcgcaccctccagccaccactgcctccctccccccttccccagcgagcgagtatctctaagcaccttgcccctcaaatcaccgctttccaaaaggctttagtggaaaacaggtccagggtgggcccagtggagtgggccccggaggcatggggcacggggcttaggagaatattcggatggcttgcgtggctgtgatgtggcagacgggacactctgggtccgtcctctcgcagatgcgtactgcacactccatgcagaacaggttgtgtccgcagggcacaagggcggcagtcacttcgctctcaaagcagaccatgcaatcccgcccgccgccggggctccgcaggccgcccccaccaagtttagagaagccctggagcggctctcccggggggcgcctcgggagtccggccagctcgggtcccgcggaagtggcaggggagcggtgtgcgcccgggggcccagcgcgggccttggcggaagaggaggaggaggaggaggcagaggagaagagcacggaggtgggcgtggcgttctcctggcccgcccacagcggggggctagtctcggccacgccgtagtacacatcctgcttgcccacgccatagcccggaaagaggtacccgccgtagccaaagtccccgccctgctcacccaggcgtggggcctcaaagccagagtccactccgcactcgccgatgcagcccaggctgttctgccggaaggtggagaggggcttgcagccgggctggtgcacccgccaggcgtcggagtagcggctatcgattgctgcgtcggggctccccgccaggaagtcgttttcattgttgtactcgaggatcttgccagtgcgcaccgcgatgtgcgtctcgatctcctcgcgcgcacgctccacgttgcctggggcacccgtgatctcgaacacggggtcgcggtcacggcttggtgtgataatgtatgtgttggtttgctgctggatgcgcttgatggttgcccctttggggcccaccaccagccccaccacgcggtagggcacccgcacacggatggtcacctggccgggcagagcaggagccacaccaaaggcggcgcctgacttgttgcgggaggcacggatcatggagaagtgctccgctgctgagatgatttcccgccgggctgtggccacgtcctcccgtcgccctgtcaccatgaacactggttcctcgcccctcaccggtgtcttgatgtaggtgttggtcttggccctcaaggccttaatcttgcagcctgggatagggcggggaaggagagagacaaagaaacgcacacagcaaggtttgtgctgggaccaataaattcctgatccttacccaaatacctagcctcccaggaacacttcagtctaccctttgaaatgcccactgctgcacacacagtccaccctgacttgaagaaaccatttatcagatctcagatgtgcctaatgtctctctcagccacagatttcaaaatgtactaactttccctgagttccattcagggccctccaaattcattcactcctcaaaacccccaaataatcactgaccctcccatacaagctggtaactcaaatccattcacaaactacactcctttctcccaacatttgctcttccttcaatttctctactgattcctggctactcacaaacttccaaatcacttaatcaccccccacatctgtcactgaccctgatctttccacagaaccccaatgtgctcagtaacctcataatctactcatctgacccttgatcattaaaagtgtcctccaaactacccagggaccactgaagtctatctgctctatgaccgccccacatgccttccactcagtagtttctctcagtgggcctcaaattcatagcgagtttgcagcaacgagtagagtgtaggggactgggaaaggtctgacaatcataagttcaaggaggaaaggaggagtatggagttaaacttctgtgtgagggaacagtgcccaaccccgtgtcactcttgtccccctgtcccctgggggcaagacagctgagctgggctggggctgagtacggtgagggagaggtattttggacccacactcctgctttgaagtagaagtgagttaaagctgggaggttagggaaaggcaggaagagaaagaagaaaaatgagacaaagagagacaaagagggagaaggctagagagaaaagtaagggctattctgtttctaaaagctgccgacctgggggtctggacaagtccctctcctccttacccaccttcctcttccctgctcctagcttcacacagagcttccaagactcatacccttttgggaagcacacgtcacgtgtgtgagttcacacacatgtacctaagaggtgtgcctttatctaaataatacttatggggccaatctaatgtacacttttatacacctctttcacacacacatcaagtccctgtgtttcggcctttcatacatcccactgtccatccccatcctccccagcacacaaacagcacattcctatacacacccgcacccatgactttcacccccaatcacatatagacccactcacacccttctctgagcacaactcactattccccttctctctccaaccgaaaccaagtggtcctacttttctgcctctgccccaaccctccaacctgagacctgaggtgagctcattttttcctccttcctccactccagatggctgcttcttcaacgctggcagattggggggtgaggggaagagagtaggttgggggaccctccctcactttttttgtttgtttttttttgagatggagtcttgctctgtcacccaggctggagtgcagtggcataatctcggctcactgcaacctctgcctcctgggttcaagcgattctcctgcctcagcctcccgagtagctgggatcacaggcacctgccaccacgcccagctaattttttgtattttttagtagagatggggtttcaccacgttggccaggctggtcttgaactcctgacctcaggtgatccacccgcctcggcctcccaaaatgctgggattacaggtgtaagccaccacaccctacaccctcccctcacttttaaaagaccttaagaaggaaaatttgcttgtttcctcttgtcttcagacctcttagcagttatgaagtcctacctgttgtccagcccacatccttgctgctttaatgtcagtaaatgattgttctattttcgaggtatggagggtcacaaaacagtgaactcccctctcctaccatttctactcacatatcgtttgatgggcacctgggttctggccgtaagttttgggtccaaaaacttaaatgagagctaggtatctttagcggttggggttggggtgaggaggacaggccaaggcatcgagtaagaagaaacgctagaggcctggaggtgcaaagctggtggtgggtctcttcctgggttctgcaaccccaaagaagcatctcttgaagggaagacccactgggcttcaccttcctagaggtcaaacagaggagcactaacactgcagcaggaggagggaggttagacaagagggaggacttccatatacttgactgaggggcaggcttatcttttgtgaataaaaatccccttacttttatgagggacaagcccatctgatgcggaggcagaagaggaaagaatgactccattaaattccggggcctcccaagaccacccccacacccaagaaaagatagcaatgtccgtccccacccaattccagggctttggatccccagtttctgacaagaggaaatccaactttctaaatcagaaatctcaagagatggagtgccccagggggatgagggctgtgcaggggagtggcatcttcccctcctccattctggatctctccgtgaaatccccctaacccccagcactcccagtggataaggtgggatgtggagtaggggcccccctggcccgcctccccttttcctctgccagaagctggcctcctcccgcactcccagccggaatgcagctcctctattgttccccactgtgggacagctcctcccccaccccacacctccccagcccagcctctttgcaatttccaaatcctgccccccacactctcctttgagaagccaggagagggaagggtccccaagatcccgtctgctcaatttggaccttcaccaacacccccactcacccacccagggatgctggagcagcagagggtgtggtaccagacatactacgctggattaattctgcaccccctcccaacacacccagacacacgccctccaccaaatttccaggtgaaggtttcttaccccccagcattccccctcctaccctgtcctactctttcactaccagagacccctctctaggcctctggcccaaggccgtggccagcccagaacaaaagccagagagggaagaggagaggtccaagccaggacgtagcacttccttggagacaccccttccaaaaccccagagacaatccaactttggggtgtgggtgaccacaggaccccctcctctcagcagcccccctcaccgcctcttccccaggctgggaccctcccctgggccacacccccttccattcctacactcagcccaacaaagagacagatactcagtctggcttcgagggccaggtctcccccaaagtctgtaactccaggcggctgggggccccagggatgccccctccccagcctaggagcagataccagagtacaggcttctgagtaactctttgcacattccgtcagtttttctggttaggagtggacaccccctcaggacagcctccctggattgggagaccgatcccctcccctttccctcttccagtgcgaggatatttctttgtctaaaggcagagtcctgggggaggaaggatctggagaaccgtcccgactaggggtaacggggaactttgtggcactttgaaatcagggtagggggcgggtccccctttgtggggaagggacagagccggaggcgggcaagaagggaagaaatgaactttccgcgctagggacgagggtgcccccactacagtccctctcagtggtcccggcgccccgcttaccttgcctgcccacgatctcggccacgtgctcggaggtgggcacgggaacacactccgtggtgttgctgctgcccttcaggcgcagctcggcctctttgtagagagcgcagagcttggcgtcgctcgcccctttgggggcggtggggggctggggcgtctgcgctgcgggggccgccgtcggggcggccgggggcgccgcgggcggcggcggcggggccggctgcgggggggcggccggctgcgcgggggcgccgccccccccacctcccccgtcctcgcccgccgtgggggcggggggctcccccaaacccaggaggcagagttgatcgagagccagctgaagggcgcgctcgtcttccagcagccctcggtccttagcgcttcccccgaaacatcctagttctccaaagcccccatttctttccattattccagataccactagactaggcatggcgaaacaaaagctgggggagagagagagggagagagagagagagaggtggtggaagggaaaagaggagagaggaggggaggggagaggagaggagggggtgtgtggggaggggggaacaaagaactggggaggggggaagaaagcgagatagaaagatagaccctccccctaagcccccctccccaaacaccctgtaacccgactcccctcgccccagcccccggggtgggggtggggggaaagagaagcaaaaccaagaaagcagatctcctctcctctccgggggtgacggggggcggggggctgcaggatctctgcccccacccctcccgcctcggacctgggagtctctagcccccgctgtccaggcgcccccgttaggctcccgcaccgagccccagtccgggagcggcgctcagtggcccccaatagagcccagccccttccagcgctcaaactcttttgttttaaatgaactggatggagcagcatgaaactgacgggaggggggcgcgccgggggcgcccggggcatgccgggagttgtagtttcccgcccttgggggcgcggggacaaattccttgacccgaggaggatagggatgtggccttcggtctttcctcgcagctccggggcaagctaggagtgggatggaagtcgaggtccctaattttttaaggggagggtgcggggagaaggggtagtatgcggaaacagagcgggtatgaagctggctaacgccgcgcgccccctcccaggacccgctcctgccccgcgccggccggtcctgggggcccgcttttttatggaaatgaggagggggggccggggccgggggcggggagccgggagccgtccccgctcgctcactgcggctttctctctcgctcccctctccccgctccctgccgcgctcactctccgcttccccctcccgctctcccagagtcgatcccggagcccggccgcggggagaggttctcggcagagaagacaaagcccgcagcagcgatggggggagagctgggctctgcgtgttgtgggggccaggaaagggtgccaggctggggctggaaccccctggcaaaggatggggtcccctcatccctaaacagcaagccatctcccctcgcccgccccccgcccccccagtctcggagatctcagaggcaccgactgggaggtgagttagttcacgtccttctgctcggtggagggggtcgggagggcggtggagtgatgaagtgcagaggttgaaggagtgcagggacagaactgggggtcggacggagagtgggcaggcaggaaaagtcttaaaggcctggggtgacttaaccgtttggggtgagggccttgagctttggatatgacaggagggaggagagaccaggatggactgggaacccaggcttccttcaggcctgggctgtgaatacagcttggggtgatctgtcctttagcactcatcgtaatttccactctgtttcctccacctctctcccattgaaaacctattcagggccgggcgcggtggctcacgcctgtaatcccagcacttcgggaggcagaggcgggtggatcacctgaggtcaggagttcgagaccagcctgaccaacaaggtgaaacctcgtctctactaaaaatacaaaaattagccgagcatggtggcagacgcctgtagtcccagctactcaggaggctgagacaggagaattgcttgaacccgggaggcggaagttgcagtgagtctagatcgcagagtgagactccgtcccccccacaaaaaaacaaaaacaaaacaaacaaacaaaaaaacccattcagtcccgtttgactccggaaattcggtgagaatgaaaataagtttttaaggcttggagagttaggcacttttagagtttcaggaaggtggagtgtaatgcaattttttcttctccctttaccccatattttctgcatttattttatatcaccctttttatgtctggatctttcccaagggaagaagggatggcactgcagcttgagggctcgaggtcagacttgaagaagaacttccataaagagttttataatagtgggtgggtgagccacagtggtaaggtgtccttttctggagtgacttgaaaaacaaaaatctgaactagtttgtaagataaagtcctgctgagaggcaaggaaacagatgaattgacttcacagacttagcaatgtggggccttgagggctgagctgtttagtccagttccctaaactgtttcttggaaagagtgaatttgcacactaatgggagtgctggaacctgagctgaggatctcagaaggtcggggggtggtgggggcagttggcacactgcagggatttttttcctttgctaggcagaagatccagggaaggagaaccttgactgaggaacccgggagggtcctggagttggggaagtttgccccctggactggggatttaacataagatcaacagtaaaccttattgtgggatttgatgctactgccaccaagcaagagtgaaagaggaagaattagagagacagggccctggagagtgggctatttctgcctcttgtcccctccgtctgccccaggaacctggattgcagagactgtggtactggggaccatggggtctctttgggagaaagtttttgctttgtggaccaggtgactatctttcacataaatagaaatagcaaacagttgcataggtcttattgtgtgctaggcatttttgtggggccaccagctggctgagccttcctgtccccactgaaatgagattccccccagactcccaccctgaacttgcgctgcctctgctttcctcctcactaagctaattaaggcaggaggttaatgaccaaagaagccttggggatttggccagggaggaaaacaaagggcagaaacaagtatgtgtcagtggggagggtccagctgctgaatggggaaggggctggctgaaaggtggggtgggcgaggcagggtccctactggacccacttcgtccctgacccaccaacaagaatgaatcagccctctgggtaagttaatgtccaccctcagggtcccactgggactccagacaaatttccttcacagcagatgtgagcctggcacctggagggcaaaggatatgtgtgcgaatgcagttaggtgtgtggcatggtgtacatgtgagagtgtgtgctgcagatcatgtaggagagtgcccaggtgcagaggaggcccagggtgggcaccttgaggagctggattctcagagtgttttttacgaatccttcgctctctcccggaggctggtggcctcctttgttcaggagaccccctccctcaactgagaaggtagatttctgtatacaggctctccttttccctgcttgcctgatccagaattatggcaatgagagcagaaggtcttacttaaacaatactccccactctctgccttatgaccagaaaggtgtagaggtggcatacttctccctttcaggactttggaggacagcactatgtctctcatcttcatcatggtccccaaccctagctgcccagaacctagcatgcagccctgcccagagcagaggctcaataggggtatgttgagtgtaactgcatttttaaaacttcatggtgtcaggaggaaagagcaggtctccaaagataaacatgctgcttattctgccactttggggagtcatttattgctaagcctcagtttccttatctctcaaatggaaataataagccaaggtctggcagggcatggtggctcgttcctgtaatcccagcactttgggaggccaaggtgggtgaatcacttgaggccacgagttccagaccagcctgggcaacatggcaaaaccctgtctctactaaaaatacaaaaattagctgggcatggtggtgcacacctgtaatcgcagctacttgggaggctgaggcatgagagttgcttgaaccaggaagcagaggttgcagccaagattgtgccattgcactccagcctgggcaacagagggagactccgtctcaaaaaataaaataaaataagccaaggtcctaacacagtgcctggctatcttaggtgttcaatcagttttagtttcctggccctggttgttctccccttgtggttgactttagccagattgtggtcttcatgaattttcattcattcgttcattcattcagccagccacttcctattgagctcctgggatgtgccaggcactggaggagatttattctgacccatcataggtcacttgaagtcacttctaggtctagactcgctgaaataaggtcattctaaacaaacagcaaataattctaaaaataattcctgttaagccctggaatgcaggtgacctctgactctctctctctctctctctctctctctctcttttgtctttcttacacaagccaggcttctggcctcatgcctggggaacaaaggaccctgttgagttgtttagtacatacacacacacaagccaggctgcagggcaggaaaggtgacacagtggagagtccaggattcttgtggaggttgggggaggagtggggtggatgatccagactgtgtgcttgtctgtgtctggagttgtatcccttcttcttccttttttttccttttgagacagagtctcgctctgttgccaggctggagtgcagtggcacgatcttggcccactgcaacctccgcctcctgggttcaagctattctcctgcctcagcctcctgagtagctggcattacagcatgcaccaccactcctggctaattcttgtacttttagtagagacggggtttcaccatcttgaccaggctggtctcaaactcctgacctcaggtgatccgcccccaccttggcctcccaaagtactgggattacaggcgtgagccaccgcgcccggccaggaattatatcccttctttcctctgagcacttctgggcacctgttatcactgtctgaacactcagtaccaagggatgggggtgcacacctaacacttgcccctccttagccctattctcagaaccctgagggagggagacacaggaggctgccaccaaggctgccttaccaagcagactggcccttaaagaggtcatctcccccatcttcatacttctctcaggatgccttctctatctgtcctagttagctgagccttctctcccatgtataatgagattttcccattttcttttctttcctttttttttttttgtggggggacagagtcttgctctgtcacccaggctggagtgcagtggcgccatctcggctcactgcaacctccgcctcccaggttcaagcagttctctgcctcagcctcctgagtagctgggattacagatgcctgccaccacgcccggctaatttttgtatttttagtagagacagggtttcatcatgttgcccaggctgatcttgagctcctgaccttgtgatccacccacctcagcctcccaaagtgctggaattacagtcgtgagccatcgcgcccggctcccattttcttttcttttcttttctttttttgagacaaggtcttgctctgtcacccagactggaatgcagtggcttgatcatggctcactgaagccttgatctcccaggataaagtgatcctcccacctcagcctctccaatagctgaaccacaggcacatgctgccatacccagccaatttttaaattttttgtagagatgagatctcgctatgttgcccagtctggtcttgaactcctggcctcaggtgatcctcccacttcagcctcccaaagtgctgcgattataggaatgagccaccatgcccagcctttctttccttttttttctttctttcttttttttttttgagatggtgtctcgctcggtcaccaggctggggcgcagtggcaccatctcagctcactgcaacctccgcctcctgggttcaagtgattctcctgcctcagcctcctgagtagctgggactacaggcgcgcaccaccacacccagctaatttttgtatttttagtagagacagggtttcaacatgttggccaggatggtctgtatctcttgacctcgtgatccgcccgcctcggcctcccaaagtgctgggattacaggtgtgagccaccagcccggccccagcctttttttccttaataaccctttcttgtgggaagtctgtgttgctatctaaccaccgtcctttctgctaagagtccagacagttttctctcctttgatagaatgcactcaacacattaattaatttaatttaatttttttgttttcttttttttaaccttataccagcagtccaaacctcactagcattaattaattttaatcaatgagaatatggaataaaattctgtaggccacacaaaagaaatgtgagacttgatccccaccctcggtaagacacagaaactggcctgcatgacccagagaacatgggtaagcaggattaaatgtaaggacaaaatggtctttggggtagagcacggtggctcctgcctataatcccagcaccttggggccaaggtggaaggattgcttgagcccaggagtttgagaccagcttgggcaacaaagtgagacctcatctaatttatttttattttattttatatattttttgagacggagtctcgctctgttgcccaggctggagtgcagtagcacaatctcagctcactggagcctctgcctcctggattcaagcaattctcctgcctcagcctcccaagtagctgggattacaggcatgtgccaccacaactggctacttgtttttgttatttttagtagagatggggtttcaccgtgttagccaggatggtctcaatctcctgacctcatgatccacctgcctcagtctcccaaagtgctgatattataggcgtgagccaccgcacccagcctattttattttattgattaatttatttgtttgtttgtttattttgagccagggtcttgctctgtcgtccaggctataatactgcggcatgatcttgactcactgaaacttcgaactcccaggctcaagtgagcctcccacctcagcttcctgagttgtttggtctacaggcatgcgcaccctgcctggctaatttttgtattttttgtagagatggggttttgccatgttggccaggctggtgtcaaactcctgagctcaagtgatccgcctacctcagcctctcaaagtgctgggattgcaggcatgtaccaccatacccaacccttgtttatttatttatttatttatttatttatttttgagatgaagtcttgctctgttgctcaggctggaatgcagtggtgtgatcttggctcactgcaacctctgactcctgggttcaagcgattctcctgcctcagcctcctgagtacctgggattacaggcgcgcacccccacgcccagctaatttttgtatttttagtagagacggggttttaccatgttggtcaggctggtctcgaactcctgacttcatgatctgcccgccttggcctccattgcactccagcctgggcagcaagagccaaactccgtctaaaaaaaaaaaagaaagaaagaaagaaagaaaggtctttgggactcggagggctacagaggttgggggagagaggtcactgtgagtccttctgttgttgtggatctgatctccaagggctttgcaggctcagcctaggtttggagatggacaaacgtctctgcttctcccctgggactacactggcacttcctctgccaggtcccctgcattgtctgatttccccagggagagtagctcagaggggctggggtggagtctgggccccttaggacagctggttgatgaggcccctctgggacttagggctggacccaggcgtccaggaggcgggtgatactggagctgtgacagttggtccccagattccacacccagtggcgccagctctggtttcgagctgcggtgagggagggggaggggcacctggtgccagccaggggctggatgctgtcttggggcagggagggggaggcagtaaacatgtccttcctaggttgttgaggattttctaattgccctctctgtgccaggcactgtgcaaggtactaacgagattctgcaatgcaagatgcagtctggcacagatgaattgacagcatacagtatagaattagaatgtcagagctggactagaagttgaatgaatgaatgagtaggggaatgagtgaatgaatagttcatcagttacctaatgcactcattttacagaggagactgaggcccagagaacccgagtcctgtgactcccttctgctttctgatctgtcatgcttcctttttcaggaaagggaagcaaaaggcagagagaggggtgggaagggacttgacgtttcctgagtgcatgtttggtgccaggctctgttctggtcttttcagacttgatgtaattgtcttcacaattctgtgaagatggacttggtgtctctgcttcacatgaagggacctgaggttcagagaggctaagtaactttcctaggtcacagagctggtaagtagagactttagtgttcaaaaccagagcagtctgaccccagagcctgggaccccagaggtagacagtgatactcagtgagtgcttggagcccacagagggtggagggagtggttcctggatgaagtagatctgaagggtgggtgaggttcatttgaaaggcgagaattggaggcatgtctggaagttggtgctggaggtgcccagggagacttgctggttgagcaggtggccggcttgcatggatcttggggagcaggggacaggttcaaagaaacacatctttaaacattggccaccaggtggcgccgcaggccaattcctagaagcggctccagcctcagcgccctcactagggcccaggtatgacttcgctgctcagccagggctccatgctcggcttgcttcctcaggtgtcatctccagcttccgcttgcccctggcttctggcatccaacacatgggggataatgatgctaccagtcgtttcctgactcgggacgaacacccaggtagctgagacctgggaatccccgtgggtctgagcagctcccccggtcacccggagacccctccagtcgcctaaacctggcttcatgtccagcgcccttctgagtttctgggagacactgttcagaggacaggctgaggaaacaggcatttgagtccaactgacctgggtctgaagggaaataataatatctaccttgtaaggatttaaaacatttcatctatggccaggtgcggtggctcacccctgtaatcccagcactttgggaggccgaggcgggcagatcacctgaggtggggagttcgagaccagcctgaccaacatggagaaacccggtctctactaaaaatacaaaattagccgggcatggtggcgcatacctgtaatcccagctactcaggaggctgaggcaggagaatctcttgaacctgggagacagaggttgcggtaagccaagatcgcgccactgcactccagcctgggcaataacagcaaaactccgtctcaaaaacaaacaaacaaacaaacaaacctttcatccaataaatatctatcaaatacatgctgtgtcaggaactattctaggccctgaatacatcagagaacaagatagacaaggtccctacttgcacggagctgatactctactggggaggaaggcagacagtagtcaagtagataatgtactttctggtagtgatcatcactgcaaagaaagataagccaggatatgggggcagaaaggtttgaggtggctaatttagaaaggatggtcatgctatctggccaggacaacatagtgagaccccatctctacaaaaaaaaattttttttttttgagatggagttttgctcttgttgcccaggctggagtgcagtggcatgattttggctcactgcaacctccgcctcctgggttcaagccattctcctgcctcggcctccctagtagctgggattacaggtatgcatcaccacaccgggcaaatttttgtatttttagtagagatggggtttcgccatcttggtcagactggtctcaaactcctgacctcaggtaatccactcaccttggcctcccaaagtgctgggattacaggcgtgagccacagtgcccagccaaaaaaaattttttttaattagccaggtgtggtgagttgctcttgtagtcttagctacttaggaggctgagataggaggagcacttgagttcaaggttacagtgagctgtgatcgtgccactgcactccagattgggtgacagagcgagatcccatcactattcaaaaatttacaaaaaggctgggcacagtggctcctgtctgtaatccaagcactttgggaggccgaggcaggtggatcacttgaggtcgggagtttgagaccagcctgggcaatatggcaaaaccccgtctctacaaaaaatacaaaaattagctgggcgtggtggtgggtacctgtaatcccagctacttgggaggctgaggcaggagaattgcttgaagttgagaggtggaggttgcagtaagctgtgattgcaccactgcactccggctctagacaacagagcgagactccatctcaaaaaaaaaaaaaaaatgtgatcatgaaatgcccctgataaaagcaccatcttagttccccgttgccatcagattcacactccttagtgtggtgatgatgtccctcttgtcctggccagctcctgcccacctctccagcccatcctgctcctccttcccttactccagccacatggactttctcctttctttcttttcttttctttttttcttttttttttttttttgagacagaggagtcttgctgtgtttatgctggagtgcagtggtgcgatctcggctcactgcaacttccgcctcctgggttcaagcaattctcctgcctcagcctcccaagtagctaggattacagatgcctgccaccacgctcagctaattttttgtattttttgtagagacagtgtttcaccatgttggccaggctggttcgaactcctgacttcaggtgatctgcccaccttggcccccccaaagtgctgggattacaggtgtgagccaccactcccagcccacatggactttctttcagggctttggcctgtgctatcatcatctgctattccctgacccttcacctggctaatgtttgttcatcttgcaggactcaatttatatgtcaattttttttttttttttttttttttttagataggttctggctctgtcacccaggctagagtgcagtggcacgatcttggcttactgcaccctctgcctcctggctcaagccatcctctcacctcagcctcccaagtagctgggattacaggcgtgcgccaccatgctcagctaatttttgtaatttttttagagacagggtttcaccatattgcccaggctgatctcaaactcctgaactcaagtgatctgcccgccttggcctcccaaagtgctgggattactggtgtgagccactgcgtccaactacatgtcactttttcctagaaatctcccctggtcacttctggatatcccttacaattcatcatgctctattgtaactgtatgtttacacttctgtttccccagtacacgggaagctctttgagaacagggattggatctagtctactcctgtattctcagcacccagcacaaagtaggtgcttaataaatgtttgctgttcggaaattgtgtatgctcatccatccttccctcttgaacaccctctcacccatatattgccaaatattccacttctccctctgcttttctggcatacctttcactcccacatccagctccatctctcctctccccttccatccccactcctacacctgggccctcgcagcctgccctcatctgatctccaaggggctactgtctgcatgaggtttagtatatcctgtcactgggttcctccactctccagcacctggtctggggccgtacacagcaggaactccatagtgttgctaactcactgacatgacttggtggatggctcagaagggatccctaagcatgcatacacctcctctcagtcaccgctagtaaaatgagtctatcacgagaagtatacatgggtcacatgctcctggccaggccctgtctatcctctagggctttgcacacactgttccctctgcctcgaaccctctctctcattttggctatctcccactcatccttcagacctgagctgaagtggaggagtcatgtcttctctttttttgagacagtcttgctgtgtcacccaggctggagtgcagtggtgcagtcttggctcactgcaacctctgcctcccgggttcaagtgattcttctgcctcagcctcccgagtagctgggactacagaggcgtgccaccatgcctggctaatttttgtatttttagtagagacagggttttaccatattggccagggctttggcctgtgctatctcaaactcctgacctcgtgatctgcccaccttggcctcccaaagtgctgggattacaggcgtgagccaccgcacctggccaaggaggagttgtgtcttctgagaggccttcctgaccatgctgatggtcttacatatacccccaagtctgctgtggcactcagtatttacccatttgttagcacttagctcctagtgctttctttttttttgatggggtcttgtgctgtcacccaggctggagtgcagtggcatgatctcggctcactgcaacctccgcctcctgggttcaagtgattctcctgcctcagcctcccaagtagctgagattacaggcgtttgtcaccacaaccagctaatttttttttttttttttgagaacggagtcttgctctgtcgcccaggctggagtacagtggcgtgcactcactgcaacttccgccttgctggttcaagtgattctcctgcctcagcctcccaagtagctgggactacaggcgcacgccaccatgcccggctaccggctaatttttgtatttttattagagatgtggttgcaccatgttggccaggctggtcttgaactcctgacctcaggtgatctgtcctcctcagcctcccaaagtgatgggattacaggcgttagccactgcacccggccaactcccagtgctttcaaagccagtttgtgtgttcatgttactcggactgatcgctctccatgaataagggatgtgtctctccaaaacctagcatataggaggcattcaataaaaatttattgagtaaatgattgattgaatgaatgaaaggaataaaatgaccatgtgatactgaatgagtcactccccatctcagtttcctcttctcaagtgattctcctgccttagcctcctgagtagctaggattacaggcacctgccaccacacccagctaatgctttttttttttttcttttttgtatttttagtagagacggggtttcaccaggttgggcaggctggtctcgaactcctgacctcaggtgatccacccgcctcggcctctcaaagtgctgggattacaggcgtgagccactgcgcccggtgtccaagacacttctaacgccaacatccttgtactaggccctcttccagctcccccaggagtctgggggttagaggtcaggctgctccccactctattacctccccacacttctaattaattcttgtgttcagtcccagaacctggagagttacactcaggctgcctggtcctgcttattgcccatatcctagaggcacttgcatgcccttccaggcgggtaactgtacatgtctctcccaggcagccttcacagactactcaggggtatggattggctccagctctgacactcagacctgagcagaggcgtgatctactctggcctcctgtgtttctgtgccccaccttcccacactgcccagggctccctgagagtgatgctgagtctagtctcagcttttatgttgctttgcttttgacctctgacccaacacatgcctcctttccctctgaagtcttgattttctccctggcttttctccaccttctgggtgttcctttttggccttctttgcccatctctcctcctctgtctacacagccaggggctcccccttccgtttcctctgcctggaacacacttgcttctccctttctgactggctattcaagcaggatcctgtaggtgggtggcagtgcactgtgtattacctgtgagccctatgcaaattaccgcacatctctgaacctgttttcccatctataaagtgaagctaatagtagcaattacctcatgggattgttgtgcaattagtgggaagaggcatgtaaagtactgacatactgtctagtacacagaaagtgcttaataaatgttggtgattattatccaggactcagcttaatcatcccttcctcaggcaggcctgccacacaaccgcagaccgggttaggtgccgggttttctgctccccagcgtttggaggcactcatcacacattaattactttatccatgaagatgaaagctgtctttggcacccagatggtactgagtaaatatctgtgaatgaatgaatgatgtggaatgtctcctctggaaggacacagtcagggcctcctgccactcaggactagcctggatgcacccacagggaaggagaaggtggggctggtctccgctgggccagcaggtggcgccagggcctgtcggtctctccccttggccacctcccttgcgcttgctcatctcatgcccaggcgctgagggttctcagctggggcaggagagatggggtcctgaggcctgggtgaagttccaagccctggggctcgggggcagactctcgctcacccctcccagaaagatgttttcctaggggatgtccagcctaacacggcagggaaggaagtggtggtcacctgggaaaggggccaacctgagaggttgggggtcctgatgaggctgctattctcttgaggacatgaaatgagaggcggtgaagtcagtcagtgagtcaaaagctgagatctaggaaccagacacaatgtgggagaagctgcggtgaaatcaatcagtgagagaggaaggggaggcccggtttccatgacaacggtagtgtttgtggcaagctggggactcctgggtccccagggcccgcaagcagtgattcaccacaggaaagggaaggctgcagagtgacctggtgctggggaccggatgccttgtggctccttctcactgctgagcatgcattcccccagcccaggccttggatctctgctctgccagctactggcagggaaactgagggatggcagaactgagccccaataaggggcaggcgctttgctccacgccgtacatgcacatatcacttatatcacttattgctcacaacagtcctatggaattaccgttatccctgttttatcaaagaggaaactctcagcctggcccacggtgccatgggcaggacatgagtggcagagccaggattggaacccaggctagcctgactctttaccatgcttgggaaggcccagaaagcagaaaaggaagagcaggagcatgagagttagaggatggttcagaccccagaggagatggaccccaaggcccctagcctccctgcctgccctgccctatgcgagcccaacactgatacggaggaaagctggccaactgcatggcctaatgtgggccagaacctgggcagccagcctacctctcactctcctccaagcccaagagagtaggccccagttccagtccatccaactggatggtagctcccccaccgttttctctctgccctggtcctaggggcaggggtgcgtgtgcgtgtgtgcgtgcgtgtgtgtgtgtgtgtgatcatcatgtctacaccacccaccaccatcacccctatcctccagcttctgctatagcctgggagttcccagccttttagtccctgtcaggatagtttcattcttgttcagctttggggcccacacaatttcagtacaaaaggggtatgcccatctcaccctgggccttgatagcatgcaagagcatagttcaggccctcatcatctattcccttgtagtagaagggatggaggttggaaagaccttagaaatcttccagtctggttctcttgttttgaaggtgtgaaagctgaggctcatagaaggggagcaatttttctgaggtcacagagcaagttaatggaagagtgaactagattccctgtccacagacttcaggttctgtaatcccagaaaggacttcttgaatttggcattgagttcttaggatgggagtcaggtagatgaacagatggagtgagacagatgaaattggataacctagcataaaatgccatgtgaaaagaaggtacgcaactcatggcccgactgtctaccatgttacatcaggaataactgaggtgagatcatgggaaagacttctcacatatgtatgttaggggtacaagatctgtggtcaaaatgggctgtgtgatcccagacaaatcacttaccttttctgagccccagtggtaactcaggataccctacctgcaggcttgtggagaggatggagggggtggtgggagagtacttgtgaactgtggggtgacatgaatgttgtcagttgtcagggaaggcaagtcatgtctagtgggactgagatagagctaccctgcagtgcaaaggtaaggggtaagccatgatgctcacccctcccacccccatccttgggagagaaagggaggaacataaacttccagtatgcttgatacaagcaacagttctccctgggggtgggcagcaggttcctgtagacccctggggtgcccagaggctgtgggaagctgagcactaattagctctggctttctaatcgggcttaattgcctcctcatgatgggcaattaggaagctgcatcaattagcacagggaggtgacaactcagctggggttggtcagggctccccgttggcagggagggaggcaggcaggcaaaggctgccccactgtcagccccttccttccctttgaaggagagggccctggagccctctccttagcaattaggccttagttccttagctcctaggagctactagccttctaggcctggattgtggcttttctggccttggtttattcaccttcactggctctctgacttttctgcccagaggagacttgcattctgggcctagctccaccactggctgctttgcaactttggggttgacagctatggagtcaaggttgagaatgtggcctttgaagctaggtctctagggtttgaatcccagctccaccgtttattaattgtgcaacattggaccctttgtgctttgttttctcacctgtaaaatggaactgataataaaagttctgtcctagctacacatgaggctggggcaggaggattgcttgagcccaggagttttaaggctgcagtgagggacaatagagtaagacaccatctctaaaaaataatttaggccaggcatagtggctcacaccgtaatcctagcactttaggaggccgaggtggtggatcatctgagcttgggagttcaagaccagcctggccaacatggcgaaaaccctacagagtctactaaaaatacaaaaattagctgggcgtgctggtgtgcacctgtaatctcagctactcaggaggctgaggcaaaagaattgcttgagctcaggaggcagaggctgcagtgagccgagatggtgccactgcactccagcctgggtgacaaaaaaaaaaaaaaaaaaaagaaaaatgcccatgtgtcaccccagatcaattactaatcaaaatatccaagactttgggcatttgcagttttgaaagcccccttcctccaagcaatgttgatgcccagtgagggttgagatcactagatgaatggtctggagggctccatccagcctggcatagcacctccctgtcacataccactcaggacccctctgcatagccctggaggtgctgcactttggaagagagctcattaccaccagtgtggctggaagcaggttcctctccactcacttagagggagttctcctctataaaatgagaataatgaccttgccatgctcacctcccagggctgcccagacataatgttttactagtgataggacctgctttataggtaggcaattatattgttccttcccttgaaaaacttttatcgaggtctagtgcacacccatctcctttacacatggtgactatggagttaataatctcctggagggacctgtcctgaaccatcagacaagttaggtcatagggccaacccccttttttagctcctgctggttatgaaatgagccaaggaatggaaagagcctagaacaggtcctgacacatggtgagtgctctctaaacagtagctctccttactattgttattgtgaccgtgccccaggctaggttggagggaggcctggttgcagtgcacacagggagctcagatgaagggaggcagtgaaggtggggcctgcaggaggaaggggagtttagaatgaggtgctgaggagtaaggtgtgtgggaagagtagaggaaggagtagagcacatcgaggttgctggttggtgagggggctatgatgaggatactctactcaaacatgtattgagaaccttttgtgcaccaggcactgtgccaggtgctggcagagcaccagatccacccagtctctacccttgaggagtccctctaatgggggaagacacacatacacagacaatgtcacagacagtgtgacaagggatactggtggcgagtggggacatttaatccagacttagtggcacttttagctgagcctggatgatgagtaggagttgatcagagggtaaagtaaatgccatgtctggaaaaattagtcagaaagcaatgagagaggttgagattgctggaatttagataaggctagagatgcaagcagagcctaggtctcggagggcattacaagtcaggtcaaggaatttggacttatcctaaatacaatgtggagccactgttagtttaaagtcttctggaaacaaaatgaggctttcattttgaaaagatcgctgtgggctgggcgtggcacctcacgcctataatcccaacacttttaggaggtcaaggtggaaggatctctttgagccccgcagttcgagaatagcctgggcaacaaagtgagaccccagctctacaaataaaaataaaaataattagttggttgtggttgcatgaacctggtcccagctactcaggaggctgaggcaggaggatcacttgagcccatgaattttggattgcagtgagctatgattgcaccaatgcactccagcctgctggatgacaaagcaagatcctgtctcaaaaggagagagggaaggaaggaagggagggagggaatcactgtgggaaggagaaacaatgggagcagaggcaagggtggaggcagagagactggttgggaggctgctgcagttacccaggaaggaaggacggaaggaaggaagggagggagggagggagggagggagggagggagcgagggaatcactatggtttatagaggagaaaggatgggagcagaggcaagggtggaggcagagagactggttgtgaggccgctgcagttatccaggtgggggttggtggtgagcagaccagagagctggaggtagaacatagaacagataacaattctggaggtaggaaccacaaggacttgggggctcattggccaagggagatgaaggaggagaggctgaggaaggaggagcagagtgaagctgtgtgttgggagacatgaactccatctgagatatccaaggagtgatgatgagttatggatgcttaggaatcactcctggtctgggaatacttggggtcgtcttctaagaattctcaagagtggaaggccactcacccttggcccagtgccaggccctcgccttccctagtctctctgggacaggctgggaattcctggctcagaaataccctgttggggcaggccggccttgatgctccccagcccaaagggaggaatgtgcctgtgcacctgctccgtgatacacgggggcgggacagtggagtggaggtgagtgaattcaggggtgttcctcacttcccccatcctggacttctaggctcagttgtggccccaggaatggattctgagtaagaggccagaaagcaagttctctgggcctggggtacagagggcagcaaggtacagttgacataccgcagacacccaggcagggcaagggcacccaggtttcagtcctggttctgtcacctctggttaggagctgtgagcacccaagggctcattcttgtcctaaaactgggtcttcaagatggtttggtttaggtggtgtgaatgaacccttccatctccaccctcgagagagctgaattttcccccacccgaggcgttccacagtgggcagaacgccgcagcccagtctgccctggcccacccagtgctcatctccatttccagcccctcctgggcgcctctggcctcctgcagccggctctttgcgctccttcattaagctttggtttctgtgggaatgtgacttgaattaactcttgggagaaaaatcacagaaatcaggaaaggggggccatggggagggggcagtgagtcacgtttccatgtgtatttttcaaactttccgatgggagtttggaaaacaacagtcttttggttgccagcttgggcccagctctccaagggtcccatatgctgtgtctataggtcttcccgtaactgctgcgtcccggcccacccttcgggtctgccttatttcctgggatcccttcccacttctccctggggacttgtgctgttgcagaggcactgagaagtccatcccgtggtgcagcttccgtctctcccctggtttcatttcacagccaagccctcatctatccttgcctcaaggtggacccatgggggctgcagctgagctggggactttgtccctgcagctgctctggccaaccctccaaccctggagaacctccataggcaccaggaagtcctgggctctaggaacctccttcctgcccccacagcttcctctttgtgtcctgcctaccagtccttcccgcccatctctgcatcccagtttccagagggcctgtggctgagggtgagaagccagcgatcgacccccagggagaagtcttgcagaggagggtcctcatcctaatgaggccgccaaggaagagggcccccagtatgcccctcttgtgtgctgggccctcgcacttcctctgtctgggactcctctaacagctgtggggagggtgccaggatccccattttgcatacagtagctgaggctcagccaggaaaatgggtgggaaccttaaggatggtgggcagatggtggcccccttgaggaggagatgggagggcagcgcatacccctagccaacccctccttgcaagccctcattcgggcggggagaaggaaggggtcctggactagctctcctgtgtcccctctccgggggctgccccctcccagtttctgactaatcctttccatcggcagtggcatgtcctgcccctgctgtgcctgtgccaacaacagcccacatcacagggccacatctggctccatttgaacataccccaccctccctgctctttatccctcaacgccctcccctgcccaaggaccagagtagggagtggccctctggacccccttctctggctccaccagccctgctcccctgccctttcgaagcctctagtggagtcactcctttccttccccgaacccggcctcagttcctgggacatcctggctccattcttcagcacaccctccctcatcatatccacactccttggctccccccttcacagcccccactgaaggagggattgggaaggggacattttgcaaggtctgagccccaagagatgtcccagagtagagggaaggcctggcagcccagggattttcccttagcccagctctctggcatattgccagcttgggcgtgttgggcggcaggggtcggggtgatcccaagaggtgcgtgtatggaggggtatagctcagcctcccagctcgggtggggagcggtggctcaggcctgtgtaggctggcttttgttggggaggagcctggaagggcctgcagctactggcctccctcctccttcctccttgcttagcaactgttgtcgtctggtaaatatttgccccaacaggatctggggctggagcactggcgtcagccgaggtagttgccccctcctcaatttatgagtctcccctctgttcagttccctattccagagccccctggactggattctaaatgtggtcctcaccccctccctcatggttgatttcctccccaacctcttccctgtctcccttttactctccttcatccccactcatcctctgtgcccaggtctctctcgtccatcctccactcctggatccattcaccaaggggcctgagtgaggtcccaccccctaagccacacaggtcctctgcttctcccccgctacatctcactgggaccccagcctggcaacggctagtgcgtcgtcggtgctcagttagccccaacatctctttcctttcctccaacaggaaacacaccttccacctctaaaccttagctccaccaagctccaaggggagagaagagagggcatatgggaatgttttgctggaccccatactgcactcccaggccaggaagctctgcatcaggaagccagcaccattttcacctcctctggggtaggactgaggggaccatggccaagaggaaacagatgcccccttagctcctccctgggtagcctgagcgggccagggcctgagagcatgccagttttagcctgtcttcctgtccttcccagccagacccctctcatcctcctcccccagtggttttctcattacctgtcactgacggagagcccctcagaggtcaaggccaaagtgaggtgggctcttggcatgctgtgcaagcttggagctcacccggcaaagagggccaatggggtgctcctctggggcgggcctgtgggctggcttagggatagcagacaggggaatctggggagttggactaatgtggatctagaagggaggtggttgggctgcacgatgccttaagactcctcccagctctgaagttctacttctaggcaatgaatgatgaaacgctggcccaagtgcagtcccttccccatcccacagggcggagaccccagccatccctactctacttggcagcccccctccccactcctcctgagagtgccccttgctccaccccagcggccaggaaatctcctgcagattcaccaccaccctcctggctgggagttcactttcctagttgacctcctggcctgagggccagaggagagctttcaacggggaccttgaggagtgtgagggctgcaggggctgtggactggagtggattcaccagggagcaaaggaaagtgaagtttcagggcctctcagttgcacgggccctttcaagacccgaagaggagccctgccaaactttccacatgatcccatgtccataacatttgcaaaaagatcattttgtatttcttaaagagggcctccccacaaaattgtgtgcactttaggtaggatgaacaactgtccctattttagcattaaaagtcccttatctggccaggcacggtggctcacgcctgtaatcccagcactttgggaggccgaggcaggcggatcacgaggccaggagaccgagaccatcctggctaacacggtgaaaccccgtctctacttaaaaaaaaacagaaaacaaaaaacaaaaaaatagcggggcgtggtggctggctcctgtagtcccaggtactagggaggctgaggccggagaatggcgtgaacccgggaggcggggcttgcagtgagccgagatcgcgccactacactccagcctgggagacacagcgagactccgtctcaaaaaaaaaaaaaaattcccttatcctaggagactcctcagtccccggcaaacccagggcaattgcccaccctagtttcaggctccacaaacatttggcccacactgggttgagggtgagggagaaagggaatccttttctgcctcacttcctggaaatgtgtaggggcgtgagctatggggcgagggggccctctcctccagctccagtcctggagttgtggcgcttctgtttgtttccttggcaacagggaaaggaaacccccatttaggaggccggggaggccccagcaaccacacacacacagagacacacagactcacacgcggccgcccacacgcagtcgcctgcgtcagcaccagccgtcaggccctcgctgcccgcctgcggggtgtggagtggggagaacagccccgcctgaatccagtccgactacccgcccctactgatttgcctgggacgccgccggcccacatggccccacccacgcctctgtccccacccccccacgcctctgtccccacccccccaccgcccccggcagcgttccccccttaacaccttcccccaggtggtgaggggccaaagctcggggatggacaagagaaaggaaggagatgtcactgctgaatttctgctgaatttccttctgcctgctgcccgatttctatttgactggcaatagtctggtgtgtattgtgacagttcagggagcctgagactcacaagtgaggtggcgatttgggcctggttgggtgggggaggtggtttggaatgccgggaatggagctcctggggagactgtaggattttgctgttggattgggttccttgggatctgggtcgaagagggaaagagtatatttaacctggaggcagaaacctggggtttgggcctgcttctgtcacttgtcagctgtgtggcctggagacaatcagttagcctgcctaagcctctgtctcctcagctgtaatatgcagataatggtgcttgcctgtgcacctcaaagaaatttgagaaggctaaggtagtaaccttgattgtgaaaagcttgtcaccggggggactggggcaggtgggagggcttggttactacttatccagtcgcccctccagccccgctggctcagtgagcccagcagccacttcccgactttgtaggaacccatgccagtccctaagtggacctgctctttgacatctgtccagtgtggctgccctgtctcccatggcagcgtggcactgagctgcagtgctgtcttggaggttttgaccctgcctggctgtgtgactttgggcaaatctttcctcctctggcctcagaattccacttataaagaaaggggcttattcctcagagcccaggggcctcctggaagtgggctggggggatcaaccaggcaggggcctcaagctccctaagtagagaagctctgcctctgtcatttagtagattgtgctttttgggtgagatttcatttgagtgagggggatctctgactttacaaatagctgtcattcacttgctccatctaagggcccgcttctcacccggcaccacctatgagcctgcctcattcccccttgctgagcctgagaagaaatctactcagctgtgctacctcaggtcaattacaacctcgtggagtttgggttgttgttttttttttcttttttttctttttttttgagatggagtctcactctgtcacccaggctggagtgcagtgacatgatctcctgcctcagctccctgagtagctgggattacaggtgcatgccaccacgcccagctgattttttgtatttttggtagagatggagttttaccatgttggccaggctggtcttgaactcctgacctcaagtaatccacccacctcagcctcccaaaatgctgagattacaggtgtgagccactgctcccagccggaatttgggttcttgacacataaaatgcagataataatacctacctcataagattgaggtgaagattaaatgggatcacctccatatagcccctagcctggttgctggcacatggcagccccttaaagagtaggcacggtcttccactgtcaaggttataactatcacctgcacatgagtgactcagcacttcaatcattgtttaataccctgtagtcaaaggatgaataagaccctccctcaagaactcactataaagagattcccaaaccatgtcccagaatctgtacatcacctccacctcctcagaccctcctccaaagagtcgcctgtctctgactcctacctgtccagggttctagccacctgatggtaagatcttggctttccaattcaggcaaactcgtattaaaatttcagttctggctgggcgtggtggctcatgcctgtaatcccagcactttcggaggctgaggtgaccagatcacctgaggtcaggagttacatggtgaaatcccgtctctactaaaaatacaaaaaaattagctgggctaattttttagtggcgcatggttgtagtcccagctactcgggaggctgaggcaggagaatcgcttgaattcaggaggtgcaggttgcagtgagctgagatcgtgccattgcactccagcccaggcaacgggcgaaactccatctcaaaaaaaaaaaaatccagttctgttactaaccatatgaccttagacaagtgattctcaataaggggtaattttatcccccaggggatgttaggcaatgcctgaagatatttttgattgtcataactgggaatggaagtgctactggcctaaagtcgggagaggctagggatgttacaaaccatctcagagtacaaagaaccttctctgacaacagagaattatctggcccaaaattcagtagtgccaaggttgagaaacctgaccttaaatgaataatttaacctttctgggcttcagtttcctcatctgtaaaatagggctattaatagtatctaccttgtagagctattgtattggtccaacaaaataatgcaagtacctagtgcctaataataaaggtagtccataaatattccctacacgaatggttcttagcatgcctctggaatccctcctggcttcatcactgggctgaacccaccggaccctagtttggcttatttcttgccaaggccagtgctcctgactctttcttcactggtcttgatgctttccttctctccttgacctcaaggcctatcaagcagctggaagcctctccctcaggccccatcccagcaccaggcccctgcctccacctcccacttctcccttcccgtctctcttccccctctttccagccttacctctagtggctccccatgccccttggcaggtcagagcacactcagctttttcccacttcagcacctctgcacagacttcctccagccagagtggcagaagacagagaagcatgtccaggatttggaccagactgcctggtcccagttctgcactgggcctgttacttacggcctagttttaggaaagtcagcctcatctgcaaagcagggaaataatttccaacccatgaggttgttgtatggacccagttgagaatgtatgaaaacatgcaacaactataaagattgttaaaatgtaagttattcactgtgtgagcattattctgctaaatgtatgcatgtatgtatgtgtgtgtgtgtgtgtgtgcatatatatatatatatacacacacacatatatatgtaattttttttttgagacagggtttctctcttgctcaggctggagtgcagtagtgcaatcacagctcactgcagccttgacctcccaagctcaggtgatcctcccatcttagcctcctgggtagctgggactagaggcatgtgccaccacccccagctaattttttttttaagagatggggtttcactatgttggccaggttggtcttgaactcctgggctcaagcaatctgcaatctgcctgtctcggactccccaagtattgggattatgggtgtgagccaccatgctcagcctctgctttatatttttatttccatagctcctaccgtgttctaacaaactataactttgtctttggtttattgactgtctccctccactagaatgtcagctccataagggtagggatttttgtctgttttattcacttctgcatccctggtgtctagaatagttcctggtatatagtagatgttcaataaatatttgttgaatgaatgaattctctgtgtataaggcagttctgtaaagcccctaaatcttccttctccaagaagccctccttcaaatgtatgtaaccttatttagttattgcacatccccattttacagatgatgaaactaacgctggaaaaacttgtccagagtcactgacctgaaaagtggcagggccagatgcatttgtttatccaagaaaccctgagagggctgggcatggtggctggcacccgtgatcccagcactttgggaggctgaggtgggaggatcacttgactccaggagttcaagaccaacttggcaacatagtgagacccccatctcttaaaaaaataaagaggctgggtgcggtggctcatgcctgtaatcccagcactttgagaggccaaggcaggcagatcatctgaggtcaggagttcgagaccagcctggccaacatggggaaaccctgtgtctactaaaaatataaaaattagccgggtgtggtggtgggtgcctataatcccagcaacccttgaggctgaggcaggcaaatcgcttgaacatggaaggcagaggttgcagtgagccgagattgtgccactgcactccagcctgggcaacagagcgagactccaactcaaaaaaaattagaaacaccgagtgcctgctgtgtgccaggtgttagggagacagatgaccaagacttggtcctttctgtccctcacagcactttcaggaatgggggtcacagaggaaacactaggatgctataagaacacagaggagcccccccacccaatcaaggtcattggtcttcaagataaagtgcctaggcctggtgcagtggctcatgcctgtaatctcacactttgggaggctaaggtgagggggcacttgaggtcaggagttcgagaccagcctggccaacatggtgaaacctcatctctactcaaaatacaaaaattagccgggcgtggtggcacacgcctgtaatcccagctactcaggaggctaaggcaggagaagcgcttgaacctgggaggcagaggttgcagtgagctgagattgtactgttgcacttcagcctgggtgacaagagcaaaactctgtctcaaaaaaaaaaaaaaaaaattctcaaaccgtccgttggacccaaccactgcatgctgatttcactcatgcatgctccagctcccagacttctgggatccctttggaattcatccaattcagagtcctctactgctctttaatcatttgtgcttgttggttttgcttctccctctgtctttcccactggtgggaggctcccttgggagcaagcatagtattgctatcaccctgtggcatagtgtgcagaactcttgcacacccaggagctcagtccccgtctttgatagccactctacccatactacaggtaagaaaactgaggtccagagaattcagtagcagatctagcatcactcagcagttaagaggtaggattagaatgtggtcaccctctagccaccactcccatcacctctcacctccagcaggctcagctcctctggacctggctgctgcttctgggttggtgatttttgccctggcaaagggagagcagacttatgacatctggagtccagagttaggattgaatattcaggataaagtttcactttgaagttcagatttaggattgaggccattttgatggtggtcgcagggaacctttagaaagagcttggagtgaaatttggggtgaaagccctccttctttctcctgcaccttttccacaagatggggaggtctggccagacacagtggctcacacctataatcccagcgctttggaaggctgaagtgaggatcatttggggccaggagttttagaccaaattgggcaacatagcaaggctccgtctctatcatgatagcctatagtctcagctactcaggaggctgagataaaagaatcacttgaacccaggaattcaaggttgcagtgagctatgatcctgccaccgcactccagcctgggcgacagaccaagattctcaaaaaaagagcggggaggtctaggacaggaagggttaagtgtggtttagctttcccagcctggaaaggaagccaggccaagcagctgggtaggggaaaagggggcactgagtgccagggaggggctgaggcagtgggaacagcatgaacccttccctcacgtttcactggcttacccctcctgcctctgcttctggtgtggagaagaacaagactttttattgtctgggaagctgagggtgggtgccacgccctgggggagagaagccatattctgggccccctcatccgggtgcatccctagtgctcaccatgctgcccaggcaccctcactgagatgagaactttccttgttcccctcccctaataaccaaagttcctgccttaatcccactccagtccctcatccaccccgaggccaggcttcagaacccagaactgagggcctgtccagccctgctttccttgtgtttgagggaagccctgatatcttggagctgtacaaggtagcaacataatttgatttccctggttgctcatcggaggataagctgtgggaggcagttgggcagggcatgcaggcagatgggacccaggcctcaatgctgtcacctcttagagaggataaggtgggacgggcatggtggctcacatctgtaatcccagaactttgggaagctgaggcaggcagattacctgaggtcgggagtttgagaccagtttggccaacatggtgaaaccccatctctactaaaaataaaaataaaaaaaaaattagctgggcttggtggcaggtgcctataatcccagctactcaggaggctgaggcaggagaatctcttgaacccgggaggtggagattgcaatgagctgagatcatgccactgcactccagcctgggtgagagagcaagacttaatctcaaaaaaacaaacaaacaaacaaaaaaaacaaacaaacagaggatgaggtggatggtgggaccaggataggggccaggatgaggggaggggagtggaaggcttatcaaaagggtccttggtgaggcctgaggatggaggctccagagcctgaggtagcgaaccctggggacctgagtgatctcgttttgtgagagagcctggcccctccccagagccagctgcagaatggacctggccagagaggaaagtagagatgagtatggtgctggcctttgcagccagcaaggctgtggggtctttgctgttcctgtcccccactaccttcttgccccccactaccttctttctggctgaaaccaggatagagacccaatattggctgtccagcccccagccctgcttcccctttcaggcccctctgggaaccacagaaatctgggacctagtgtcttggcaacgtaatgaatgcatgcacagctctggtatctgttttaaattatccattaaaataagtacagttctgggggaaaaaaataagttgactgggtgcggtaagcagtagaaagggactgaagggggaaggaacccaggcagtgcttgggtccaaaggaaggggacaggagatggaaggggcagtgcctggctcctattcttggctttctttaggggacttctttaggggactgtggcttgttgcttgggtctaaaaacgaatgcttggctttgaagagagatagattggggcaaaagaaagaaaaaaagggaccccccaaactccttgatccctggccccaaactgggggcataaaggaactcaggttccagaactttgctccccccagggaacccaggcattccttctccaccccactcctggcacactgagatgcagctctgaatgggctgcccacgtgtggaggggggttggggtgactcactattactactgggaggacagggggagccagtggtggaagaagggtgagtcacactgatgggcaccagcctcagccctccccccactttcctggctcccagccctgcctacctgaccctctcccttgctttgcgcccacttccctctctttctccccgacccttttgcccacccactctccctccttggctctgccctctagcccagaaggtctgaggcaatgggggcaagcttggagccgacagtgctgagcaggcaggagccaagagaggggaagcttgagcctcacgcagttaggggtgcgctggagagggtggggcccgactccgccacaccccaacggtccttccccctcctcaccactcccgcccccacccccaatggatctgggactgcccctttaagagtagtggcccctcctcccttcagaggaggacctattagagcctttgccccggcgtcggtgactcagtgttcgcgggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcggtgagttcgcccaggtggctgcgtgcctggcggggagtggagagggcggcgggccggcgcccctggccggccgcaggaagggagtgagagggcctggaggccgataactttgccatagtctcctccctccccggaactgcccccagcgggtgactggcagtgtcaaggggaattgtcaagacaggacagagagggaagtggtggtctctgggagagggtcggggaggatataaggaatggtgggggtatcagggacaagttggggctggggccggcctgaattcggtcagattgggatttgccaactatttggagccggggggaggggcttgagcaaaacagaactagccctgccagctcgaagaactctgggcacccaggacacatcggagtggcagaaagggtcctgttagaactttgttagcgggcttggcactgtgctagctttgcccaagctggctctgaacacatgatgcccactaagacataactctcaagttggcatctgtccagcgtgttggagcgaggtcaggaaggcagggcaatcccccttttccctcccaagggcttggcggtggccccccctcagcatgaccttgtcctgggttctaagggttgggaagttctccctcactctgccactctgcgtgtctgggaccttccttgggctctgacaggcccaccaaaagagctccgggagatgagagatcggctcccccgcagctcccacagcccttggcctgcttggcccaggaatgcaagggagggagggaggcagagggcagaggctcccagctcaggaagttgtgttatgcccaggtctggccgcactcctcccttggccctctgcctagtgtcttcgagggttgggggcactgtccttccctccttggggtgagccactttcattttcccagcggggccaggcagtctttgctcgggcccatcctcttagctgctgacgttttgatctttgtcttattgaagtgctggaatacagtgacatttttgaaatccagccgttggaagattcaggccactcccactttacccacccctgccccaccctaccccaccctactcaactgcaccttcttcttttctaaaaaagcctttgggagcttggaagtataggccctctcttccagccccatcaaaatttgtttcccttcttcctgccttccctttctctatgcagacccaggccaagagcactaagggtgcttggagatccgtaaagggctgttggctttgacttcttctctctcttttatcatctactccaaacttctgctcttcctagaaccctttgctaggtgtggttttgttgcccaggctggagtgcaatggcacaatctcggctcactgcaacctccgcctcccaggttcaagtgattctcctgcctcagcctcccgaatagctgagattacaggcatgtgccaccatgccgggctaattttgtatttctagtagagatggggtttctccatgttcgtcaggctagtcttgaactcccaacctcaggtgatccacccgcctcagcctcccaaagtgctaggattacaggcatgagccaccacgctgggcccatcacccttctttctgaagagtcaatggaagttgtgtgtaggaagacaggcttaacggtttttttttgagacagggtcttactctgtcacccagactggagtgaagtggtgcgatcttggctcaccacaacctctgcctcccaggctcaaaagattctcctgcctcagcctcctgagtagctgggattataagtgtgtgccaccacacatggctatttttttttttttttttttttttaatttttagtagagatggggtttcaccatgttggctaggctggtctcaaactcctgacttcaaatgatccacctgcctcggcctcccaaagtgctgggattacaggtgtgagctaccatgcccggccatcaacctttattttgtttttttgagacggagtcttgctttgttgcccaggctggagtacagtagtgtgacctcaggtcactgcaacctctgcctcccaggttcaagccatgctcctgcctcagcctcccaagtagctgggactataggtgcctgccaccacgcccggctactttttatatttttagtagagacggggtttcaccatgttggccagggtgatctcgaactcctgacctcaagtgatctgcctgcctcagcctcccaaagtgttgggattagagacgggagccactgcgcctggcttctttttttcttgagatagggtttcactctgttacccaggctggagtgcagtggcaaggtcatggctcactgcagcctctacctctctggctcaagccatcctcccgcctcagcctcctgagtagctgggaccacaggcaggcaccaccacccacagctaatgtttttgtattattttgtagagatggggttttgccatgttgcccacagtcttgaactcctgggttcattctgctgaaagagaccacacctgtccttttctttatttttattatatttttcagagacagggccttgccctgttgctcaggctagagtgcaatggtacaatcataacttgctgcagcctggaactcctcctgggctcaagcgatcctaccgtctcaccttccggaatagctgagactaagggcaggcaccaccacgcttggctaatttttttttttttttttttttttttgctttttgtttgtaaagatggaaacttgctatgttgctcagctggttccgaagttttggcctcaagcaatcctcctgcctcggcctccggaagcactgggattacaggcataagccaccaggcctgacgccaggcctgtcttttttctactagtgatatgaacaatttagttagcaagacagataggaagcaaggaaggggagacccagagaattcgttgcattctaaactagtccactcatctaccaaagccctgtgaaggacatttttagcagttttagcagttttctggtcaaaactttgatcgagaaacagattgagtggattcgatattctcttgctcacccagccacgccagtttgtctcctctgcctcctagtgcagctgtccaggcctgggacaccaggcgggtatgtgcgcatgtggggcagggcggaggtggtgtgtgtacttgttatatttagccacctccctctgttctcccccactgatcctggctggaaaggctgggcttccggaaaagagaggtggatttgcacacctggatcccaagctgatagaaagtggggtgaagacaaaggggactcagactggggtgtctgtcctcttctatgcccacagtaggaggagccaggattggttactccctgctgggtctgctgtgctcagagtgaggtagagaagtgggtagagtaaagaatttgggagaggaaaaaaggcattttcccaacccctcccaccaaagcctagagagaaggtgttgtctggtttaatgtttaattagagctcagagttcagggccagatttggagttgggatggaaagttgtttttaagaccctgtagcaatttttgacccagcctgggtacctcaaccacactcaggagtttgggggaccttctgttgggctggattataggctccaagaagaaacccctttcgccaatactctctctctcttctttttttgagacagggtcttgttctgttgcccaggctggggtgcagtggcatgatcacagctcactgcaacgtcagcctcacaggctctggtgattctcccacctcagcctcctgagtagctgggattacaagtgtgtgccaccatgcccagctaattttttttttctttttttttttttgagacggagtcttgttctgttgccaggctggagtgcagtggtgcgatctcggctcattgcaacctccacctcccaggttcaagcgattctcctgcctcagcctcccgagtagctgggactacaggcacatgccatcacgcccagttaatttttgtatttttagtagagttggggtttcaccatgttggccaggatggtcttgatctcttgacctcgtgatccgtccaccttggcctcccaaagtgctgggattacaggtgtgagccaccgtacccggccactaatttttatatattttgtagagatggggtttcaccgtgttgcccaagctggtctcgaactcctaggctcaagtaatccacctgccttggccttggcctcccaaagtgctgggatgtataggcatgagctaccgcacctggtaccccctgccccttctctgtctctttctagtctgtagcccaagggatttggatacccaagtgcaggcagaatgggaaggttgtaagcaccagggaagcctgtctggagtccaggcttgcagctgggccccaccccaggcaaggcagctgggtggatgactcagatgctgcccccctccctcccaccctggtggctttacagaagacagcaggagacagggtggagacagcagttgtcttaaagggaggagtggtggtctgaatgtctacctcttctgcccccctccccattgcatcctggagtcccttgcctggctccttcctgagaccctctggtggtgtctggacacatagctctctctggacaggtaacatgcacaagtaattagaatccagagttgagttcagagttatggattgggctgcaggatagtgccagggtctgtgccttcccatgtgaaactgatggaggaaggctgagtcagaagtggggagatccgaggcccacaaagcagaagcgctacttccactccaaaaaggccctggtgcttgacaacttcctggattgcccactgttgcagccccagtgtggacaggcagggagatgcaggctccagttcatgtaggctctgatcaagacaagaacagcaaaggccacagaggcacagatgcttgtcccatgtcacacaataaaggggtcagcacttgatcacaggccttatgacttccagctgggtgtgctcttaccattaagcctcacttctctagcttgggggacaggttggagggaggatctagagggtgaggtaaggtgaagtcaggtagctgaggctcacttctgcagcctggaaactctgctctggggccagtgacaccttagtgctctatggccatacttcgtggctcatgcctgtaatcccagtgctttgggaggctaaggcaggaggatcacttgaggccaggagtttgagaccagtctgggcaacatagcaagacccccttctgtacaaaaaaattagccggtcaacacctgtagtccagctgcttgggaagctgaggcgggaggatcacctgaagccaggagtttgaggctattgtgagctatgactgcactactgcactctagcctgggagagagaaagaccctgtctctgaaaaagaaaaaaacaaaacaaaactctgctgtcctgcagggcctgttagcatatgatcgatagcctttgctccagcctatacctggacccaggacccctgccagcccctcaatcgtgagacggtcagagctctgggaggctggtgattcttgtcttgagactatcttgagacttgtcatgggaattgtccacccggattgaaaggaagctgtgccttttggcagacccattaggttaatggggttggagacctttgaggatgcatgggccctgggctttatctgagggtatctcctggtgttacctctccaaccctccaccaccaaatccattctttttttttttttttttttttttttgacagtctcgctccctggcccaggctggagtgcagtggcatgatcttggcttactgcaatctccacctcccaggctcaagtgatcctcccacctcagcctcccaagaagctgggactataggcacgtgccacatgctcggctaatttttctatttttagtagagaccaggtttcaccatgttactcaggctggtcttgaactctggggcttaagcagtccacccaccttgacctcccaaagtgctgagagccactgagcctagcccaaatccacgttctgattcaaagggaaagaagaagggtgcagctaaacctggggggtgagaagtacttaaaaagcccaagagaaacaaaagagagaataattcctcactaggaccccctattgccttcccactattggtgcccttgcttggcacttcccctggcctccaggagtctgagacttactcttccatggatgtgcccattgcccccacttccaggtccaccccccagtgattcggtagcttagtgtctgcgctgaagcccaggacagctggatggacaactggtagatcccttcacctaccaactgtgctttctgctcccctcccccttgcttccctcctccccagcccctcgccacccctagcagctgcagcagccaagaccaagtcttcagagacccagacacaagggcagggttcattccattctcacctccttggggtcccagtgtactgataggccgaactctaatattataggagatctctggaagattgcagggtctcttatccctcaataaggggcaaggcaagccgggcgcagtggctcacgcctgtaatcccagcactttgagaagccgaggggaacagatcacttcaggtcaggagttaagagaccagcctggccaacatggtgaaaccctgtctctactaaaaatacaaaaattaaccagaaatcgcttgaacccaggaggcagatgttgcagtgagccgagatcacgccactgcactccagccagggcgacagagcaagattccgtctcaaaaaaataatactaataataaataaataaataaggggcaaggtagtccaccaacaaaatgacaggcagtgtgatatagtggacaccctagccctcggtgcccttagttctgtgtgtggccctttcactaaattgctgtgtgaccttgagcaaatcgcctcccctttctggctttccttagctgtaaaagaaagggattggagcggaaagtctccagagaccttttaggttccaaagtagtacagtgacccacaaagtgagaaaacagtcttctaaaataccaagttattaatagtaaaatcaaatataaataatgtgaatatagttaatagctaatgttgttctcaatagaaatgtttcccacaagctgtggaattaaacatactaccacatttctctatttccccgtgaaagtttgttagaaatggttaaattgtgacattaccctcttggcaaatgttttgttttcattgctactaggaaagggcaactcgttttcgatgcctctcccttctggacggtggaaagggctgtgtcatagagtaggaacgggagatgcggcacaggaatggctcccattgacccgggttgggggctagggcgaaggcctaggagaggcagaactgttaccttagagctggccaggattagagaacagtgcctggaaccggggggaggggcacggtgaccttgggctgcccaccttctacccttccagcacccatactggctcccccaacctgcggctgggctgggaggaggtcttggcccctaccaatcccttaaggaaggggaaagagtttgggaaggggagtcctcccttcacccctgcctcccccaagttgtgagagaggaagccggaatcctgcctgctgaagccaggaataattctggctgagatcccaggcccggcaggggcgctgagtcatggtagagggcagagtggagagtggacaggagaccctaagcttgtccagtcagaaaagcagaggctgaggggtggccttttcttgagaactacattcaagttgcagcaagaaggacagtggtctgaatttgacggggacaaatggaagggagataggacacatgagttcctttaggtctggctcaggggagctagacttcatttcaaggggtctaggttctgggcagttgagaaggaggctatttggggtcaccaaggctcccctttcttcccaaagctctaacactgccaccttctgctggctaggagagagctgtgtcttctgaggctagagctggaatgcagtgagaccagactgcctaggtcctccctcacttcttctcctgaccttggggtgtggctcccactctctcccagtgtcctcagggttaataactatgtgccaccagatagagagttaaggggctgctgaattggcttcttgtgaagggaatcccctaaatgtccctcgttttggtcactggcctccctcccgcccccttcaggacattctactatcttcttaggccatccctccctcctccaggcactacttcttttgctctatccccaagccccacccctgcatttttgtgacaacaccggaatgatttctagagagagaggccaggaagaaggaaagtggcacttggcaggagaccttgcagggggcggctggtgaggaagccagccgcccattgtccaggaccccagtgccctggcctccggcctcaggcttctcctgcctctgtacaatgccacgttgatacgcccagcagctgtgactcaggcctggccccctgccaggcccagcacttctactggagttgcgtctgaacatgtcaacaggcttcctatccctctctcagcaccagttctccccacttcagcccctccctctgcctggaattaaaacctggctttgtcttagggaaggacagctgggagcctagtggctctggtaggggatctgagaggcctcagaccctaggcatatttggctgtttggcaggtgtcacgcccaagggaagcgtgtggaagcagagccatgcctgctgtgggtgcacatgcccgcgtgagggagtcggggtgtttcatcctggggcacctgtgggcttttgaggtgtatgatattcagaacttcacaggttggggtttggggaaggctcaaggggcttctaagtccctggaacagctgcccccctcagttcctctctctctctctctttttttttgagatggagtctcgctctgttgcccaggctagaatgcagtggcgcgatcttggctcactgcaaactccgcctcctgggttcaagtgattctcctgcctcagcctcccaagtagctgggactataggtgcccgccaccatgcctggctaatttttgtatttttagtagaaatggggtttcaccatgctggccaggatggtctcaaactcctgacctcgtgatccacccaccttggcctcccaaagtgctgggattacaggcgtgagccactgcgcccagcctcagttcctctctttaaggtctcctttccagagagggatagcacctcaaatgccagggaggggaattctccacatcctgcccttacccgagttgtggcagacccacagactagccaagaaaccaagcagtggttactttgccgggttgggggggaggtaggggctatcaaacctcatgattggccgcacacaaaggtgtgagtatgtgtatatttgagggtgggtgggagtggcactttcactaggcctccgtatcactctctgactggggtatctcccagcaagcgagacagaggcagacacgcttcccagactgtcttactgggtctctctgtgttattctctgcagtgtctgtgtgtatcgtgccattttctatgttttgcaccaatctgctgtgagtgtcctcaggtgacctgggggcaggtttttagtgcctgagcctacccgtctccaggctttagtttccccctgtaaaagtataggagttggttcaagagaaggttcctctagaagccttgagcctgtgaaccgtctagtctccgggtatttgtgggacacacagaaaaagccccacgacccaacaggtagaacactggctgaaatcagcagggcagagctgagacaggctcaagtaggctgaggggtagggaggttttgggtgaatgggagggagggacagagagaaggaggatatattgcagtaggaggagttgctggaacaaaaggaggggtggtaggagtggcttggggtggcagcagaagacgccctgtcacatggcgggaagtcagcctgggcagaggtctaggtgtccaggaggggctgggtgtggtggctcacgcctgtaatcccaggactttgggaggctgatgcaggaggatcacgtgaggtcaggagttcaagaccagcctggccaacatggcgaaaccctatctctactaaaaatgccaaaaattagctgggtgtggtggcaggcgcctgtaatcccagctactctggaggctgaggcacaagaattgcttgaacctgggaggtggaggttgcagggagccgagatcgcgccactctactctagcctgggcaacacagtgagactctgtctcaaaaataataataataggggctgggcgcggtggctcatgactgtaatcccagcattttgggaggtggaggcgggtggatcacctgaggtcaggagtccgagaccagcctggccaacatggcaaaactccgtctctactaaaaatagaaaaattagctaggcatggtggtgcaggcctgtaatccagctactcgggaggctgagaagcaggagaatcacttgaacctgggaggtgaaggttgcagtgagatcacctgggcgacagaatgagactccacctcaaaataataataatagtaataataataaatgaaaaattttaaaattaaacaattaaaaattttaaattaaaattaaacaaattagatgcccaggaggatacaggagagcatttgccaccaggcggactccctgtacccacccggccacagggggcgatgttcctgggagacaggaaatgcccaggggctgggagaccctctgctcttctgctcccttcctgtgtgctgcctggcaatggggaactctgagggctggtgagcagggctgctgaggagtgggtctaaggagtccctgcagggctgggccagctcctccacctcccctttgtcttcccctcccacttgttatttttagctacagtgtctgtccctcttgcttctcccccagattgggagaggaaacggaggcctctccctccgggcctagcctgttgcccccagcaaccgggcccaaacaggcctgtggccggccctggcttccatatctggcatcagagttgggctgagcagggtgactcagagggtgggtcagcgcctggcccggtgcccacctagcccctttgctgtgctggtgcctttcttccccaaacagccccaagggcccgggcctgctgcagctggggagccggacttccttgtcccaccaggcacagctcttcagacccctgccttgggtcacatttgcaagtgccaactctcatttctaccttattcttttcctctctgttcccctccccaccccctctcttccctctttctgagatcagatttgccagtgatgggaagagttagaaacaggatgcccagcccttctcgcctcaagaggccactgggatgcagccactcctgtgcttggggaacctggaggatgcaagggaaaggactggcactctgctggcacagcacccggcctggggcaggacacgggcgaagccagggtctcccctgtgagcactagaggatttcccgacccctgcccgggtattgtgtgcctgagcatgagtcacctgaggggcccaggttcccacccttcccagctcctctggcctgccccaccctgtcctccctgccaacccagcacggggacggcactcagcgtgtgctcagctttcctgatgccaacccccagtggagtgggctgcaccaccaccctgggaccgaatgcctggctagggtctactttggtccctgctaggtctgaggacccctcctaggaaggaaatggcacttgggggcgggggcagggaggagggaggagagacactgggctctactgtacccctagtcatctcttggggtgtgcgtgtggctccctggccacagagctcccaaggtctgagtcatgagcccatgggtgatagtggcttcttccccgcagatgggagctccccgtgcctaagaaaaccacaaaggttcttcctcacttccctctctgctcgtggtttttctcatctgcagggtgtgtcttagtcctttaatctcctctctttgcagtgctagtcaaaacctccaccagggaaagacaaataacccccttactgtttttttttttttttttttttttttttgagatggagtctcgctctgtcacccatgctgtagtgcagtggcacaatctcggctcactgcaacctccgcctcccaagttcaagtgatcctcctacctcagcctcctcagtagctgggactacaggtgcacaccaccgtacccagctaaattttttttttttttttttgagatagagtctcactctgtcacccaggctggagtacagtggtacaatctcaactcactacaatctccgcctcccaggctcaagcaattctcgtgtctcagcctcccaagttgctgggactatggacgtgcaccaccttgcccgactaatttttgtatttttgatagagtcagagtttcaccatgttggcaggctggtctcgaactcctggcctcaagtgatccacctgccttggcctcccaaagtgctgggattacaggtgtgagccaccacactcagccagcccccttactttccttggagaccatatactgtggcttgtgccaaagtggtacagcatggatttccagctcccctatctacttgctgcgggaccctagatatagctttctgtgcctatttcctcaattgcataggaatagcacctatcgcatagggtagctgtgaagatgacgtgagttaacataatatttagagcagtgcttggtacctaataagctctatataagtgtttgctattatattattattatcactgccaccaccgcttttgcaagcagcagaaggtgaagaggttagactgaagaaaaaacttctgtgctcatcagcccataagctcgcagagcacagggatcatgcatctatgttttcctcagtcagtgtctgccaggcactggcaaggaaaggctgttaccagggggaactccaggaattcctcctggcacctaaggaggctggggagacaggactagggaaaaggtgcccttgagacaccttctgaaatcatcccattgccttccagcttctttcagctcaggctggctggtcagggaaacgctttgtgccatagtgtctgccctcttcctcctcctggcttctccattctctctggaacttgtggcttaggaaagcagtgaggtggaggaggaggaaccctagatcagcagctagaattgactggaatgctgctgctggctttcggtaattgacactgggccattcaccttcctcctttgcacctcagtttcctcatctataaaagggagagggttgagctgaatcaactctaagctccttctagttctctaaattctgagagcctcctagtacagccagcagcagccattagccttcagggtagagaggcctcttctgggaagccccagccagcctgggggtcagcccaaggagctcggaatctaagttgccccagttgcttcactttaccagcggtttttcttcattttccctcctccccctgcagctgcttcagcttcggaaaagttctgaagtcatggaaagttggggctgtgctcccagccaggggctaggccggatggcagccaaaacctgagctgggttttgactttatttttagcttttctgactgagacagaggagggaatacattctccggttctggaaggggctcttttttgcaggagacagacacttacattaaacaacttgttctgaggtgtggccagaggcctggactgagcaagtgtgcaggctgggggagcttcctctggcttctcatgtccttcccctgcccctctgagtgtcactctatcctcctccctgcctggtggggggaggtgggggtgactccttttttggactctcctaagcagaacactgcctgggtctcgtcctccagagcttctgcaaatctagccttccctatccctcttcacagtgaattgctgggcctcttggagtttaggacttttgtggtagaagaaaaatgttggcagggctgcttttctcctttccaggatagatttttccttctgcccacgcttggttttccttttttccatctgctgtggtgggctcatgcttaagcactgatgagttacagatggcagctggaaccaggtcctctggatctttccctccgctccctgggtctgctgctttctctcaccctatatttgtgaagcaattgtaacatctagaaagttcttgggttctctggaggtttttaagaaaataggacctttctatttctccagtccactagcaaaaataatcaggggcccagaaaaggtgagggaggtggcagaggcagcgctgttcgactggttatagctaaagctttacccactttgaggagcagggaggcttaaagctggggcccagatggacctggaggcctgggatccacatctggaaccagatgctgaggctatggtagatgggtagggctcagccttctcccagggcacggatgaggcaggagggagggaggcagggacccctctgttcagtgcagatcagggcacccagactgggtcctgagaaaggaaagggtcaatattgtgcctggtcatccttgtctgaggtccctctgagctctaaccagactttccttccccacagtcccacatgtgtaaaagggactaggagaggtgaccagtacctttggggctcagatcgagaagtgctagggacatgtgggccatgagcttagttgtcaggctcctcagagggagggaagcttggccaaagggaagtgagtagagtccagggagaaggctaagtaaggccctgtgtgggaaggggcaggagacaaaggtacccctgtctctttgggaaagaatgggaggagagagagggaaaagcattcatatcacggggtagagctctgcccttggccccaggcacgttcctgagccctgagtcatgggaagggtggagaagcaggaagggggttttcaaggaccttggggaggtgggagcccagccccagaggcaagcagatgcaaaccaacctaatgcaaggatgccctctcctggtaattgcaggcatagcagcgccagcccccatggctgacctcctgggagcctggcactgtctaggcacacagactccttctcttaaatctactctcccctctcttctttagcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaaggtgaggccaccctgcagggcccacccatggccccacctaacacatgtacactcactcttctacctaggccctcccccatgtggtgcctggtctgacctgtcacctgatttcagagccattcacctgtcctagagtcattttacccactgaggtcacatcttatcctaatttggctgccaatgggatctaccacagtgaatttaaaataatccaggaggccgggcatggtggttcacgcctgtaatcccagcactttaggaggccgaggtgggccgatcacgaggtcaggagatcgagatcatcctgactaacatggtgaaaccccgtctctactaaaaatacaaaaaattagcctggcatggtggcgggcgcctgtagtcccaactactcgggaggctgaggcaggagaatggcgtgagcctgcgaggcagagcttgcagtgagctgagatcatgccactgcactccagcctgggcaacagagtgagactccgtctcaaaaaaataataataataataataaaaataatccaggccatgtgtggtggctcatgcctgtaatcccagcattttgggaggccaaggaggcaggattgcttgagtccaggagtttgagaccagcctgggcaacacagaccccatctctagaaaataaaaatttaaagaaattagctgggcatggtggtgtgcacctatagtcccagctacttgggaggctgaggcaggaggatggcttgaacctgagaggtcgaggatacagtgagctgtgattgcaccactgcacttcagcctgggtgacagagggaaaccctgtctctacataaataaatacataaaataaaataatccacaagccatttctacttaactttgcaatgaactgtacctgaccctagatccctcccagtttggccctccggtatacaagggcctcctataggcccttgtgatttctctggggaaaaggaggactggagttgatcatttattgaggccatcagaagcggatggctaattacatatgggacatgtgttaataatgctttgtgtatatagagtggcctttactttcaaaacactcttctccaatttatcatgttaaaagctaggaattgggctgggtgcagtggctcacgcctataatcccagcactttgggaggccaaggcgggtggatcatttgaggtcaggagtttgagaccagtctgaccaacatggttaaactccgtctctactaaaaatacaaaattagccaggcgtggtggcacacacctgtagtcccaacaactacttgtgaggctgaggcaggaaaatcatttgaacccaggatcagaggttgtggtgaactgagattgcaccattgcactccagcctgggcaacaagagcaaaactctatctcaaaaaaaataaaaaatagccaggcacggtggctcatgcctgtaatcctagcactttgggaggcagaggtgggcagatcacctgaggttaggagttcgagactagcctggccaacatggtgaaaccccatctctactacaaatacaaaaattagctaggcatggtggcagccacctgtaatcccagctacttgggaggctgaggcaggagaatcgcttgaacccgggaggtggaggttgcagtgagccaagatcgggtcacagcactccagcctaggcaacagagcgagactccatctcaaaaaaacataaataaataaaaataaaaataaataataaataaaagctaagaatcaaagaagcagtttattcctaatttcacagtctcatctgttcatagtggggccaggattagagtcagtggccaagcttccatcctgggttctttcccttcccaggccctaccatcatagtataccagggaaagacctggagaagccagcaggttgaccaccgaaccaaggctgggccaccttcctcctgggtctggtctccagcctcccagttgtacccttcccccagcccttcctggatgcactgatcagcctgtgcttccttgccctgtttttctttataaatagagccatgttctcctctctctctctctcttttttttttttttttttttgagatggagtcttactctgtcacccaggctggagtgcaatggcacgatctcagctcactgcaacctctgtctcccaggttcaagcaattctcctgcctcagcctcccgagtagctgggattacaggtgcccaccaccatgcccagctactttttggatttttagtagagacagggtttcaccatgttggtcaggctggtcttgaactcctgaccttaggtgttctgcccgcctcagcctcccaaagtgctgggattacaggcgtgagccaccacgcctggcaagacgtgttctctctatgttgttgaggctggtcttgaactcctggctgcaagagatcttcctgcctcagcctcccaatgtgctgggattataggcatgagccaccacacttagcccagcctgtgctttcttaaatgaaaatctaagcatacggctgggtgtggtggctcacgcctgtaatcccagcattttgggaggccaaggtgggcagatcacgaggtcaggagatcgagactatcctggccaacatggtgaaaccctgtctctactaaagatacaaaaattagctgggtgtggtggcccatgtctgtagtcccagctactcgggagactgaggcaggagaatggcatgaacctgggaggcagagcttgcagtgagctgagatcgcgccactgctctccagcctaggtgacagagcgagactccatctcaaaaaaaaaataaaaataaaaaaaagaaaatctaagcgtggtgctcccctgctcaaacatcctcaggttcttttcatggcagataagggcatctcttcatgagccagcccctgcctactgacccagccacctctcccatcccttcccaccccgtacttcaggcttcagcagtactgatctttccaaagaccccagaacacacatgccttcatacctctgtgcctgtacatgcttgtttctgcccttgaaatcatgacagtagctctctgtaggccccgctagcctgtcccttgggtcttagcctcttggaggccttcccagagccccccaaaagtaccccaggcatactttggttccttctctcatgtcccctcagtactttgcacatacctcctttatagcagttgctatgttgtgccagagaagggagtcctgtggctggggggcatatatcttttctttttgagacagagtctagctgtgtcacccaggctggagtgcagtagtgcgatctcggctcactgcaacctccacctcctggattcaagcgattcttgtgcctcagcctcctgagtagctgggactacaggcgtgtgccaccatcatgcctggctacttttttgtattagatatatattttctctcttagcacagtacctaccaagagtgagtgagtagatgtcctgacccctgcaggcatccaaggccctccttccctggacctgtttccacatgtgtgaaggggtgcacaggcagcagcccacctctcagcttccttccagttcttgtgttctgtgaccccttttcctcatctctgcctgcttcctcacagcttgaggcagccctaggtgaggccaagaagcaacttcaggatgagatgctgcggcgggtggatgctgagaacaggctgcagaccatgaaggaggaactggacttccagaagaacatctacagtgaggtggggactgtgctttgcaagccagagggctggggctgggtgatgacagacttgggctgggctaggggggaccagctgtgtgcagagctcgccttcctgagtcccttgccctagtggacagggagttgggggtggccagcactcagctcccaggttaaagtggggctggtagtggctcatggagtagggctgggcagggagccccgcccctgggtcttggcctcccaggaactaattctgattttggtttctgtgtccttcctccaacccttccaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaaggtgcttgctctcgattggttccctcactgcctctgcccttggcagccctacccttacccacgctgggctatgccttctggggatcaggcagatggtggcagggagctcagggtggcccaggacctggggctgtagcagtgatgcccaactcaggcctgtgcctccacccctcccagtcaccacagtcctaaccctttgtcctcccctccagctggacaatgccaggcagtctgctgagaggaacagcaacctggtgggggctgcccacgaggagctgcagcagtcgcgcatccgcatcgacagcctctctgcccagctcagccagctccagaagcaggtgataccccacctcacccctctctccaggggcctagagtctgggccggatgcaggctggaagcccagggttgggggtgggggtgggggtgggaggttcctgaggaggagagggatgaaaagtgtccccacaaccacagagaagggtcgcaggatgtggagtcagatggcctgtgtgctgtttctgtacactcttacctcaccttcacttctcagggctttggttttcccattcgaaaatggaggctgttcttaatctccctaactcagagttgccacaggactctgcaatgtgaggtgttaaaagcatcagtatttttctagttggctgtgctatttgtgacaggagaaaaagtctagcctcagaacgagaggtttcagttagacaaggggaaggacttcccagttgccagccaagactatgtttagagcttgtgatgttcagagctggctctgatgagggctctggggaagctctgattgcagatcctggagagagtagccaggtgtctcctacaccgacccacgtccctccttccccatacttagggcccttgggagctcaccaaaccctcccaccccccttcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggtgggctggggagacgtcggggaggtgctggcagtgtcctctggccggcaactggccttgactagacccccacttggtctccctctccccaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggtaggctcctgctcagggtctaaggggatacagctgcatcagggagagagtggcaagacagaaggatggcatgtggagagaggaacatccttgccctcagagggtggaccagggtgagcctgtatatctcctccacactctggttccaggcctggctcctggactctttggctgtgagaccttgagcaggttatttaacctctcagagcatcagtttcctcatctgtaaaatggggatgaatactgatccctaagtctttgagttgtcaggaagatgaaagataaggtatccgtgtgcctggtgctgcgtatgtgtccacagatcatggctattatccccgggggaagggcagtgacaggggtgtgtgtagatggaaggagaggcctcaattgcaggcaggcagagggctgggcctttgagcaagatacacccaagagcctgggtgagcctccccgaccttcctcttccctatcttcccggcaggaccagtccatgggcaattggcagatcaagcgccagaatggagatgatcccttgctgacttaccggttcccaccaaagttcaccctgaaggctgggcaggtggtgacggtgagtggcagggcgcttgggactctggggaggccttgggtggcgatgggagcgctggggtaagtgtccttttctcctctccagatctgggctgcaggagctggggccacccacagcccccctaccgacctggtgtggaaggcacagaacacctggggctgcgggaacagcctgcgtacggctctcatcaactccactggggaagtaagtaggcctgggcctggctgcttgctggacgaggctccccctgatggccaacatcggagccagctgcccccaacccaagtttgccaattcagggcccctttctagagctctctgttgcaggctccagacttctccacccagtaggcaaaccaaaagatgcttcctcaacagcacaaggggtggaagttagacagtgaggattgttaaaggcagagccatactcctacccggagagcttgacagtgtccctctggggtggaaatgagttccttagctccatcaccacagaggacagagtaagcagcaggccggacaaagggcaggccacaagaaaagttgcaggtggtcactggggtagacatgctgtacaacccttccctggccctgacccttggacctggttccatgtccccaccaggaagtggccatgcgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaactttactcgctggcctggcctttcttctctctcctccctataccttgaacagggaacccaggtgtctgggtgccctactctggtaaggaagggagtgggaactttctgatgccatggaatattcctgtgggagcagtggacaagggtctggatttgtcttctgggaaagggaggggaggacagacgtggggcatgcccgccctgcctctctcccccattcttgttgcatgcatatcctctcatttccctcatttttcctgcaagaatgttctctctcattcctgaccgcccctccactccaattaatagtgcatgcctgctgccctacaagcttgctcccgttctctcttcttttcctcttaagctcagagtagctagaacagagtcagagtcactgctctggttctctgtccccaagtcttcctgagccttctccccttttatgtcttccctctcctcctccgggcccctagcctcccaaacccccattgcccgctggctccttgggcacagaaccacaccttcctgcctggcggctgggagcctgcaggagcctggagcctggttgggcctgagtggtcagtcccagactcgccgtcccgcctgagccttgtctcccttcccagggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccaggtgagttgtctctgctttgtctccaaatcctgcaggcgggtccctggtcatcgaggggtaggacgaggtggccttgcaggggggagagcctgccttctcttccgcagcccgggggagtgggagcctcctccccacagcctgagtcctagacagcccacctctgcatcctgcccctcttgtctgagccccagactggagggcaggggcagggctggagtgtgagggatgggggagatgctacctcccttctaggggccaggggagggagggtctgggtccaggccctgctgctcacacctctctcctctgttttctctcttagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccaggccagcctccgagagggagagagagagagagaggacagcttgagccgggcccctgggcttggcctgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttctacccctggctgctgtggtgtctttgttggtggacgtcgctgtgtgtactgaggtgcagactcgtgggcatgcgcgcgcgtacacacacacacacacacacacacacacacacacacacacacacagcgccgcacggtcactgcatcctcctgctcattgctgcccagccctgccctgctccaggggaaacaattagagatcagagcactttgggtgcacatctgggcactcggtggtggctgagggggaaggctttgatataaccatcaccacccactgtacggctctctcccaacggaagtccttcagagaagcagcacctgaaggagggcatttgctaactaacttccctcgtccaccagcacttactgagtgctttctctgtgctgggccctgagcgaagcatgaatataagacatatgatatagacccagtctgagggtggtgacatatcaggacgtaaggacaaggacacccggggaggagggaacagaagctgcaggagagggcagaggaaaggagcagttaatgtccctttgtgccatgttgtgctcaggttgggggattgggaaatgaacaagacaagatgcccactgtcctcagagaaattacaccccagtgggagtcagaaaatagactgcagacaaagggatatgttaggccaagtaggagcctccgagggggttccaacctgggggcatgaggtgcccagactgaggggaggggccccaaacagggaaaatgagctatagaagccagcctttctctggcccttcctagtttccaaagcatttctgcagcatctcatttggccttcgtactgtcttgagaggtaggtattgtctcccagccctctggaactcaggccactcagctcgaaggtggcacagatcccaagattctggaagtttatttatgttccttgggcagagttgagcctgcagtcaagagtcagtgagaaacgggcatgtctggctgggatcgtgggaaaacatgtgagaaagcaaaattactgagaggagaagggcccctgaggtcatgctggacgctcctgattccaccataggctgagaccccacagtgcctttagggaagggaagttaagcggaaggaggtttgaggaaggggtccctgcttgggttggcagtttccaagaaggaaacccttcctctcctaggcctcagcaaagaccctgaggccccgcagatatggggtcttagatgtcagcgagggagtccgtgtgtcccaaaatgaggactcccacctgcagttcctgggtcgggcaccttggggcgccagagccccaccacggtggtgcctgcacatcctgggtaggggtccttcgctactcagctgaaccctggtgagctggctgcatgggcactgtgggctggggaacaccaggggcagcaggcaacgttcctagctcttgaggaggagggctgagggcatagggccgcacacaaacactgccccacaagctggcagcacggcgggggcggcagccggggactcagcagttaaggtgtccacacacgtggtcacctcacatgatgctcacagcacaagtcagcactcagcagccacatttcattatgtaaaaaaaaaaaagttgttgttgttaaaatgtaatacatgcttggcctagcgtggtggcacgcacgcctgtagtcccagcaactcctggcctgaggcgggaaaattgtctgagctcaggagttctaggccagcctgggcaacagcaacaacaaaaatacatatcatatggtaaaattcaaaacacaggtaagggatggacacagtggctcacgcctgtaatcccagcactttgggaggctgaggtaggcggatctcaggtcaggagtttgagaccagcctggccaatgtggcaaaatgcctctactatacaaaaattagctgggtgtggtcgtgcatgcctgtaatcccagctattcgggaagctgaggcaggaggatcgcttgaactgggtggcttatgttgcagtgagccaagatcatgcaactgcactacagcctttacagcctgggcgacagagtgagactccctctcaaaaaaaaaaaaaaaaaaaaagtcaatatgttgctcagggtatttatttatttatttatttatttatttatttatttatgagatggagtctcgctctgtcacccaggctggagtgcagtggcgcaatctcggctcactgcaagctccgcctcccgggtacacgccattctcctgcttcagcctcccgagtagctgggactacaggcacctgccaccatgccctgctaattttttgtatatttagtagagatggggtttcaccatgttagccaggatggtctcgatctcctaacctcgtgatccacccgcctcagcctcccaaagtgctgggattacaggcatgagccaccgcgcccagctatttatttatttatttttaataatttttttttttaaaacaggtaagaacaaataattttttttaaatccatttttttctttctttttttttttgagacagtctcactctgtcacctaggcgggagtgcagtgtcttgatctcagctcactgtagcctccacctcttgcgttcaagtgtttctcctgcctcagcctcctgagtagctgccattacaggcatgtgccaccacacccagctaatttttggcatttttggtagagacggggtttcgcatgttggccaggttggtcttgatctcctggcctcaagtgatctgcccaccttggcctcccaaaatgctgagattacaggcatgagccaccacacctggcctggaaagattatctttttcttttctttatttttgagatggaatctcactctgttacccaggctggagtgcagtggtgcgatctcagctcactgcaacctctgcctcctgttttccagtgattcttgtgcctcagactctgaagtaactgggactacaggcatgcaccaccacacccagcttccttctttctttctcttttcttttcttttctttctttttgcattttttttttttttttgtatttttagtagagatggggttttgccatgttgcccaggctggtcttgaactcctggcttcaagcaatccactggcctcggtctcccaaagcactgggattacaggcgtgagtcactgtgcccggcaagattatcttcgtcatatcgctttttgtttattggtgtttggggtttttttagaattggagcctcactatgttgcccaggctggccctgaactcctgggctcaagcaatcctcctgcttcagcctcctgagtagctgggactataggcaccccagcttcatagcagtccttaagattaggagggggccaggtgtggtgtctcacacctgtaatcccagcactttaggaggccaaggagaatggattgcttgagtccaggagtttgagaccagctggggcaacatagtgagaccctgtctctattaaatttaaaaaataataataataaaataaaagattaagagagggaggctgaggtgggtggatcacgaggtcaggagttcaagaccaccctggccaagatagtgaaactcgactctactaaaaatctttcaatttgtaaccacatgcacacaaacttttgtccctagcccagtcgtctccattctccagaggacgatttcacacctttgcctctctctttactctcagctgctttacaccaaggagactgttccctgctttacaccaaggagactgccctttgtcaaggcccccagcaccctgcacattgctaacccagtaaccacttctcagtcctcatctaacttgaccttgtttgtcatgggagtgtggtcctcagcctacattgccaatcctttcttttctccctggccgctaagagatggagtgccccagggcttgattctcttctctgtctacactcaggccctaagagatttcctccaggcccgtggctttaatgactgtgcctatgttggtgactctttatccttcagcccgttcctttgcctggaaccccagaccggaatccccacgtaaaggtctgacggcatctcgaagttaacatgtccaacactgctacccagatttccacctacccccagtctgctctgcttatcatcttctccatctcagctcatgaccgcaccatcctttccagttgctttagccataaatcctggagtcatctttaacttctattttcctctcatacttcacattcagtccattagtaaaactccatctttaaaatatgtctggaatctggccaggcgcagtggctcacacttgtaatcccagcagtttgggatgccgaggcgggtggatcacctgaggtcaggagttcaagaccagcctagccaacatggtgaaaccctgtctctactaaaaatacaaaaattagccagctgtggtggcacgaggcctgtaatcccagctactcaggagactgagcaggagaattgcctgaacctgggaggcagaggttgcagtgagcctagatcatgcccctgtactccagcctgggcaacagagtgagactccgtctcaaaataaaataaaataaaaaataaatacaataaaatagtctggaattcaggccattctcatcaccgctgctgccaccaccatcatctgttgtctggattatggcattagttttataactggtctcttgcctttgctctgtacagtttattctccacacagcaacagagtgatcctttaacagtttggtcactcctctgctcagaaccctcagtgtcttcccaaagcacgaaaatgttaaagccaaagtcttcacaatggcatacaaagccgtgcatgatgacccctcccacctcatctgtcactattctcccttgttctcaccccattggagctaccgtggctgcctagatattcctagaacacgccacgcacacacctgcctcaggacctctgaactaatggttccctctgcctggaccatttttctcattaggtatctgcatgccttgttttcactctttcttcagatctctattcaaatgtcagtgtccagtaaagccttccctgaccaaattacattttatattttattttactttttgaggtagggtctcactctgtcacccaggctgagtgcagtggtgtgatcatggctcactgcagcctcgacctcccaggatttaaacaatcctcctgcctcggcctcccaaagtgctaggataacaggcataagccaccatgcccagcccccttaccaaatgttgttattattatttttttttgagatggaatcttgctctgtcacccaggatggagtggattatgtgatctggcacactgcaacctctgcctcccaggttcaagcgattctcgtgcctcagcctcccgagtagctgggattacaggcataagctgccatgctcagctaatttttgtatttttagtagagacggggtttcaccatgttgaccaggctggtcttgaactcctggcctcaagtgatccacccatctcgacctcccaaagtgctgggattaccctaccatacccagccccctgaccaaattttataaaagagtagcatcttcctcatcccgagttttaacctcccagccactctttcttctttatttttctctgggacatttaacactattgagcatacattacacttgtgtatttgtgtcttccaccaaaatacatacacctgaggggcaggtcttttgttgtttttttcatgctaagtccccagtacctattgcagtgcctgactatattgtaggtgctttataagtatttaaagtaaatgcatagactcagaaattgaatcgctcaatgtgagaactttttttttttgagacaaggtctcaccatgttgtccaggctggagtacagtggctattcacaggcttgatcatagcatcatagctcacagcagccttgggttcctggcagcttcccaagtagctgggaccgcaggcacgcgccgccatcctgcccagctatgtgagcacttttgcagaacctgagacctattgccaagtatcatcccaaagagtggaactaattttcactttaaccactagtgggcaggttattaccattctcattttaatgaaggcggctgagacccagcgagagaagaggtttaccccaagtcacccaggactccagattctcagaaaatacagtggcaactcagaatactgtgggaggaccaggggggctttgcagaggaaagggttgttttggcatgaaaggacaagaagggtttcatcaagtggaaatgagaactactatcccggaagagtacatcttccaggtgggagataccgtaggaacagaaactcagagaaaggcggagtccaggctgcctggggaaaagccctccctcactaaagggtcgggaggggcctacagtaccctgcggggagtttgaaattaattgcatgggctctgggaagccagggagggttgtgagtagaggggtgatatgagaattgaggctttctgctatttgtctgtctgctatcttctgtctccattttctttgtccttctcttctgccatgggtttctctcagctgccccagcccctcctggagtaactaagattttccttttctacgtcacaatcctgacagcccatcaggaagcagagggagcgggtgagccaaggtcctcctcagagcctcggtgccccctttgcgctgtgcccagaggggcagagaaaacaagaattggagaggcaactggaaaggaaggtgcctcctacgccccctgactgactctggggtgctggcctccccctgccttctggggccaggcctcaggcccttccacttcttgggctgattctccgtgcctagtaccagttggtgccagctggcagctctcactggagactgaggtggcacgcatatgggggaggggaggaagtgggcaggagcccaaggggaacagggggcagggtctgaggaggtggagtcggaagctgcgtggccagcatgggggtctcatgggatgagggaaaagtgaggcagaggaccctgggggcttccaggggagtaggggaggtgtcaggtggtcctagctctggctttcctgcccctggcaagtccagtcctctccccaccacctactttcctctacactcacccccttaagctgcccctggctaattctccttggtccctttaagagctgcctgggaactggggcactggagggggctggcagggcccccaccccctccctgccatgcctggccctgctccaccccctgtccggtgcagactctgctggaagtcttggacgcctgggttagggtctccacttctgggctgggggtaaggcttaaaagtggtggggaagggggactgtggtccctggggtgggagggaggggcgggatgccagaactctgggactatggacatggagtgtctgtgtgtcaactccagtgaacaatgcagggggtggtcctctggcctctactgggggaggggcagcctcagggatcttgaggggcatatcctaaggagcaggatgcctgggtctcctccctccactcccccatctcatttccccaagaccttcattttctaaattccatcagccactccttgccccctgcaatcaaagacacagggtcccaacatccccactccccacaggtggggaaattgaggctagacaaaccagaggaaatagaattatgtatgctgcagcaggagaaatggagattagcttgtggaaaggctctctctccctctccaccccacagaactgcaaacaggaggtctgggtgtccagctcactccagcgagtttctaactgtggctatggccaccaccctggactatgtccctactctctcatcaagactatttagctcttttctggaagttttgattctcatatggcaaggccaggggaggcccccaaagtccggctgggtgacctggattgaagtggagccaggtaggatctataggctcccccattcccttgggttatttcagaaaggtagctccttccttctctgccacagagactggatccaattcccctaaaagggaagaaaataggggcagggacacaaggatgtccaatgggggtgtgagggcttcctgcagttcacctgcttccttcctgttatcatactagttcagggtcctctactccccaccatcttaatttcaaatcatgtgtcccagtcccaggggagagaagcctgaacaggcaggtcctttctgagtccccacagccgagatgcagagaggcagtgagggtggagtgtcaggaatcagtggggacatggcggccccgttcagggtccacttccgatttcagcacatgccatgccctccttgcttcaccacaaagcaaatgctcaaccaccaccccagctcagatatgaaggggaagcagtcttggtccatgaaaccctctacccagggccgacaccagcacactcatttccttcctcttaaaaatactatgaagtctggcggagccatgctgctcccaggcaggttaaaaagccattattttatggatgtgaggcagggagggtaaatgctctgcccagcatcacacagcaggctacaggcaaccaagcctgggatctagggcccttcgccccagactcatggtgccttttctagtcccctgccagctgacagagaggccagcctggaaggggctttttcttttttcttttttttttttttttttgagatggagtttcgctctttttgcccaggctggagtgcaatggcatgatctcggctcactacaacctccgcctcctgggttcaagtgattctcctgcctcagcctcccgagtagctggtactgcaggcatgcgccaccatgcccggctaattttgtatttttagtagagatggggtttctccaggttggccaggctggtctcgaactcctgacctcaggtgatccgccagcctcagcctcccaaaatgctgggattacaggcgtgagccaccgcacccagccggaaggggctttttcaactcctcattttgccaacaaagttagggcccagtagagacataagggagctctagtaacaaggctgtttaggatcagggctgggagagggcacaggcttggctctcaaaaaggctccatacaaaccgctgcctgcctgtgctcctccccgaatgggaaagaatccggctgtcttctttccctatgtccatctagtctagacccttggaaagtcctgtctgaagtctgctctctacagcacaaaccttccccttttaatacatctcagagggtgttagccacagaaggcttctgggggagccaccttcttctcaggcagcttaggaaggagaggcagaacctgaacctggcagtggaccccctccctcagaagtcaggatactgtaaatagaagagggctccttggggttcttaacagagtctgtcccttggcttatttgcatagttgcatagatatttgtgggctcattcgtgtcctcattggcaaactgaatttgcatggggttgggctgcggtccagctgtgtcgccccggcatatacacagttcccggggtagagggaaacccagaggaactggttgtaaagaggaatgggccccagctgaccccctgaacccaggtggtgacatgtgcacggtggtgcctgctgaaggtgggcaagggagctgagcagggaccgggggctactgtacctccttttcacctcctcccgcatctggagcccctcctcctccacatgtgcgaatccaggagccacagaaggtggggcgcagtgggacatgggtaggaggaggaagaatatggggagattctagtccctcccacttagagatgcggtcgccatggtgactgaggaccagtgaggcgggatggggttgagaatgggggtgggggtgtggcaggggctgaggcactgagagaccggaaagcctggcattccagagggagggaaacgcagcggcatccccaggctccaggtaagggagcgggggagctgacagttctgaagggagggggcggggccattgtctggtgctggctctgccctaaagagggggctgacagaggggtcgggctattgtgtgtgatactcagcgcagccttccagagctagtcagactggaggaggggacctgggaagctctgggtaaggggttaggagggactgagctggtgggtggcaaaaaggctgggagacagtggggatgggaagaggtggagggacacagggggcgtagaggcttggggacgtccctagtgcctatacacgctaggcactcaatacatataagttgacttgacttgcctgtgaccataacaagagggcagatgagggccagggcaggtggagctaaggcagggaagtcaggaggcaatgttccccagaactggactcttctgtgggctgcccctgaagctgaaagggaggaggtgggggaaactggacctgccagatcactcgtgaagccaggagttgcttctctcctggctccaggagctgctcctttagtgcagcatccgtgttctgcaggggctcagaagagactgagcgtctggggctggttgaagctcagaggtagcatagagtcggggcgggaagcaacctctccatctcccctcccacctccacatctagacctttcctctgcacaatagaacctggcaggaaggggctacatcgcatgctgtgtaagggttgcaggggaggagctggactctggcagggcagagggtgcactcagtgttgttgtcatggcaggacccagggctgggctccagggcttgtggagaaatgggctgggggaaaccccagattggagctgtgaaaatgacacggcccctgtgggcaggtccctgaacatctgaccccttcccactgccaccccacctgacctgctgcctgacaccattcccagccaaggtacttctgctccttggccttggtttcctcatttgtacggttgtcaggaagggtatgtctgagtaccctgtcagccctgagcttctttgatgctgtgtgcaggacctgctatattatttgtggggcccagtgcaaaataaaaatgtagagccccttgtttaagtattatgaggactttcaacagagcaacagcagagcattaaaccaagtgtggcccttctgagcacagggccctgtgtggctgcacaggtctcgtgcccacgaagccagcactggctggggccctgccagctgaagcaggggagatggcagtggggcttggggtctgaccccagagactggtgtgaggggtgcactgctgggggcagggtgcccttcctattgctgtttttgaccaggaggcccttgcagaggcagggggtggtacctcacagccttccttcaagaaggtttctgttccctctgaaacgctttattgacacaaataagcttgcccataagggccacgcttggggctgggcacagtgtctcacgcctgtaatcctagcagttttggagtctgagtcaggcggatcacttgaggtcaggagtttgagagcagcctagccagcatggtgaaaccccatctctactaaaaatacaaaaaaaattagccgggcttggtggcacatgcctgtagtctcagctacctgggaggctgaggcaggagaatggcttgaacccgggaggtggaggttgcagtgagccgagatcgcaccaccacactccagcctaggcaacaacagagcaacacttcgtctcaaaaaaaaaaaaaaaaaaaaaaaaaagcccactcttggtttaatgctgtgcggttgccctgttgaaagtcctcagaaatcaccccagagatctgatttcttagcctagagtagataaagctcactaccctcccagcccacccttgccttctctatccaagtggctcagaactgtggactggggcaggagggaggactgagggactaggactctgtagagtctttgtagctaagagatttgctattgaatgaggcagatctgaatttaacttggcttctagctgtgtaacctcccttcttgatctgtaaaatgggattatggcagtacctagctgctaaaattgttgggagggctaaagcctgatagtgtgaactattcatattggctagaggggctggggaagaggacgtccggagttgggagaattctggatgtctggaggaagaactgggggcagggcatggagtctatgacttccagaaaggtgggaataggacatcaggctgggagtgtagggctggaactcccccagcctccccgtatcagaactcttcccagtgacccaaatgagccaatctgtttaagcagagaggcccaggggcagactggcttcccaaatctgagctgggggttggggagacacagaaggtagggtctggataaatgggagtttctcttgattctaagaaactggaagggacctggcaaccagcctctgggagagtctgggggagtcctaggcaagtcttgacagaaacgattgtcaggcaggatatgtctgagaccaacccccggggaaactgagagagatgaaagaaggctgagtacctcagatgaggaattataaggagtagcctgagctgtaacatcccccatgttggctggtgctgtagcaggagggatggaagttacactacaggaaggacttcctgccagggaggaatgtgcatgtcagatggaagtggattatttattagagttggattagccctgggatgtctgtgctctttaacctgcagtcagctgaccatgtcgagtgggcaggaacctacccactttgtaggccacagagttcttggcgctggatgcctcattaaccccgcgttatgaggctccccctggagcctttagggaggggtgagcagccacctttgggggttgggtgcctccaaagtgtggtccagtgagcacgagttcagatgggaaatgttctgggctttctactggcctgatttctgggcttcctattggcctgatgtcaaagagtgatggagattagactgcaagggggacttcctcagcaaaatcatggataagagcctaatacaattattttattttatttttttaaagactgtggcccagctgagagtgggaggtttaaaggttagaccactgcagggacttcccagtaggtaggagtagagagaccccaccttgtgggtaagtgaaaagaagaatatgtcatgtcccctatctgggaaatcttaagcaagagaagaaaccactgctaggctggttatactggctgtgacatgatggagaggcaggggaatcgctgaaatgacctagaagggcctcttaaactttctggttggaccgagcagaggagggagagagaggtgtgtctcttgtgaggtgggtgaacgtctttttattccctcccaatccaccaacttccgcccaagccaggatctgtcacaactcgagaggtggaaattccggtttccctggcctagagctcccagtgctggctttggcatgatgggcacctggagggccgcactcccgttccagccaggctgagccttctgtcccctgcctctggggcctgggaaccccccttcttctttctcctgaatggcacccccgccctagaatccagacaccgagtttcccactgtggctggttcaagggtatgtgaggtgagatgggtggcttggggtgggtggtcttggggaagattatgtagaggcccagggaggcagacacaggagcaagagacaagggggccggggagctgcagaggctgggagccggccagccacccctgcccaggcagctccccgggaaatgctgataaccaacctggtgggatggaccctcattgcctccctggaagtatcaggccaggcaggcctgagcctcaaagaccctgaacccagctggggctgggggagaggttagagcaggcagactcaaacccagtctgcctacctgggtcagagctgagtatgaggcacaggtgtcaacagatctgaaagtgacaggagagtaaggtctgaggaatttatattttgggtacaggaacctgctccccaaaatgttccctgcccagagccaggcaacggtttgggcttgggctatgagaagagggaaggcaaaggaggaaagacaggaaagacttcctgagagtaaggcaaaaaaaggcaaaccagagctgttggtgagaagacaacagaagaagcaggataggggagacctgggctcctacccataggggacagtgaggtgacaggctgaggcctggaaggatgatgaaagtgagaccgtcttagggcccttccagatagggaaccttctctgccccaatgccccacccctgccaccaatacacacgcttctgctgcctggggctctcctattggtcctcggggggatgtggtaagaactgctcacccagaaagtgcccgggtgcctgtttccccagagctccctggtgacagtctgtggctgagcatggccctcccagccctgggcctggacccctggagcctcctgggccttttcctcttccaactgcttcagctgctgctgccgacgacgaccgcggggggaggcgggcaggggcccatgcccagggtcagatactatgcaggtaagtgtccgacagcaggaagtgtggggatagcaatagagagctggaggtgggtggaggaaggagagaggaacagaggaggggaggaaatggatatggagaaacagggacacagagagagatgccagggagaaacagaggatctcggagaaagagagacacagccagaaacagaagtccaaaaggaaagaaaagccactggagagcagattgaggaaaacaggtggccacggggccaggggcacgcttcttccagttctccatgttggtaatttttctttccttccttaaatatcactgtcaccaagctgggcacctcaaactcctaactgcttcacactcccaggtaccccaaagtcaaggcccatgctagaagaccatatgtggacccggtgacccggagctcgccaggcccatgccaaccacatagatcatgctggaccataccatgtccaggaccatgggatggctggttggagaatgggccctggaacccacacacaagcacagcttggctggtttcttactgagactgtggaggctgctggccccctcacctccagggagaagactcaggaaaggatgtagacactgtaggagttgtaggtgactgggcatggctgtgtctttagcatctttctggggcaattggtaaaagaaatgtatattgctcattgatgcagagacctcctctgtgttggatgctgggcgcacaaacacggataagcctcagcccctgccctcaaggtgttcacagtcacaagggggaagacatgagcaatcagaccatcaatacagggtgatctgttcagcaactgaggggtttatggcagctctgggggaggcctggcctccaggagatgctcctccctgaggctggcccttccatcccgcagccacaccagattccccaacttctcccctctgtactgtgtaagattccctgagcctgcaaaggtatcaattagctagtcagctttctaactaatgcaacagtgcaagtgctaatgagagaggatctgaggagctccttcctccttgccgatgtgccagtgggacaggaaaatacacccccacccaccccaccatgccaaggtcatggagaggacctaggtgagcctcccacacctggctcaccatccctgcccaggggacatccagccatgcccacatggatctttgaagaaaaatgcttcctctctgttcgtggtgactctactggtgggaatttcctttaacagaagaggaagaaagcaggggtggttggggggatggcgagagggactctgacatacgccctcctgtctgcatatagctttgctgcttgtggctgccaacactttcctgtttgtctgtctgcctgctgctcctcatcctagtgaggaccaaggcgtcctccccgacggtagccctccctgtcccaggcctggaagagcatccactgtgcctcactttatttcccgtccccattaccctgcctctggctgcctctcctctctactgcgggctcagcacacaacgctcttgtgttggggtggggtgaagggaagaactgctggtggaggagagtgcatctagctgccaaggcctggggagcacactcaggcaacccttccccttcccccacttttatctcaggagtcagctgcctgcccaccaagtcctcatcactctctctgtcttactcctccaacaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatggtgaggagtccagggataaagagtgtgggctgggagtgaagagggggccggcagctaccctgggcttggctgcctgtgcatgaataacttagttgctgttatctgtaatcagcagttctctttatatgtatatcgtgacaatataacagacaggaaatgtcgtggcctcacttttttttttttttttgagatggagtcttgctccgttgcccaggctggagtacagtggcacgatcttggctcactgcaacctccgcctcccaggttcaagcaattctcctgcctcagcctcccaagtagctggcactagcatgcaccaccatgccaggctaattttaatagagacgagattttaccatgttggccaggctggtctcaaactcctgacctcaggtgatccgcctgcctcagcctcccaaagagttgggattacaggcgtgagccaccgcacccggcctgtgacttcactcttcactggtattgtgaatagtgattgaataatattaattgcaaaaatggctgatatggaaatcattgacatatgagataaacactgactcaaattatatcaataatttgatatctacccactagtagaaatcactgatgcttctgtgtctttttttttttgagatggagtctcactctgttgtccaggctggagtgcaatggcgtgatcttggctcactgtaacctctgcctcctgggttcaagcaattctgcctcagtctcctgagtagctgggattacaggcgcccgccactaggcatggctgatttttctgtttttagtagagacggggtttcaccatgttggtcagcctggtctcgaactcccgacctcaggtgatccatccgcctcaggctttctaagtgctgggattacaggtgtgagccactgtgcctggctgcttctgtcttagtcgccctattaatgggaacaatgtgaggaaggaaggaagaaagggagagaaggcactagcaatattagcaatcacctccatggttcatgtatcctgatgtgtagtctgctgaccacctgcacatatgagatgctggttaaaaatgcagattctctaaggcgtgacccaggaaccaacttgttaaacaatttccccaggaaatgtgcggtttgacaactgctgccatatataccattcatcgtgttaggtgttttgtatatgccacctggttgtatctgccagtagcctatgaaattgaccaagatctctcagtcaggaaatagccaagtctagatttaaacttgggtctgtctgattccttaggctgtgttcaactatggagctatgtctgataccagtattattcaagtaatagccatggtcacaaactgatgttattactgcccatcagcatgtcactaaccaccatgtctgctggttatttcacatcagagcagagaagggaggcaggtcacagctagaactgaggaccttatttcttttcatctcgccctcccaactccccactttcagataccgtggccagccagtgacagaaaaaagagtgaatgtgcctttaagaagaagagcaatgaggtaagtggaggtgggggagtaggggtagagtgggtagagagctctggcatccctagaccatccctggatgacctcaggttgggcggcagtggagggcacttgtttgcacggttatctcctggattatgttctacagaggcgtacagggactgccccagcattacctagcctttctcctcagtgagggggcagcctctgggggtccagcaatttgagtcaggtggcctggagacctaaattctctgtctccctcagacacagtgtttcaacttcatccgtgtcctggtttcttacaatgtcacccatctctacacctgcggcaccttcgccttcagccctgcttgtaccttcattgtgagttctctggtgcccagcgctcaggcccccaagcatcccttctcacatctacccacgactttcctctgtagctctggaaaactctggccttccagatgcaggaccctcatgaacttcctggccccagaccaatttccctctatgtccctttcccttccttcctcaagcccctcatttcccagatgtgagaccttggcgttctggccccccagcctctctccccatttaggaacttcaagattcctacctgttgcccatctcggaggacaaggtcatggagggaaaaggccaaagcccctttgaccccgctcacaagcatacggctgtcttggtgggtgagtatcaggtttcccacttcatcccaacatctactttctccagtcacgctgtgaaatatggaatattacagagttttccaaaaggcaggggaaactgggtgtggtgatgcgtgcatatggtcccagttatttggaagctgaagttgaaggatgcttgagtttaggggtttgagtctagcctgggcaacacagcgagatcgtctcaaaaaaaaaaaaaaaaagcctcagtgcctcatgcctgtaatcctagcagtctagcagtttgggaggctgaggtgggtggatcatgtgaccccaggagtctgagaccagcctggtaaacatggtgaaaccccatctctactaaaaatacaaaaattatccaggcgtggtagggcgcacctatggtcccagctactcgggaggctgagtcacaagaattgcttgaacccaggaggtggaggttgcagtgagccaagatcgcgccactgcactccagcctgcgcaacaaagcaagactctgtctcaaaacaaaacaaaacagaaaatgcagaggacagagagagagagggaagccagaagcctcagaacacaagatcagagggagaattaagcaccccaaccaccagctcctgctgaaattgccacaaaaagtggtggagaaagatgcatgtggagagacagaggcacgagggcccgggaagggtattgggtagagaagaggcctgagactgagccactgttcaacaattgtgtgaacacttcctctggtgtactgggcactgtgctgggtagtataggagttataaacaagaaatcaggctgggtgcagtggctcacacctgaaatctcagcactttaggaggctgaggcgggtggatcacttgagcccaggagtttgagaccagcttgggcaatagtatagtgagacctcgtctctactaaaaacaaaacaaaacaaaaacaacaacaacaaaattagccggacaagcgcctgtgatcccagctacttgggaggctgaggtgggaggatcgcttgagatggtcaaggctacggtgagttgtgatggcaccactgcactccagcctggatgtgagcaagaccctgtcttgaaaaaaaaaaaaaaaaaaagggagagagaaaccatgtatcaatgcactactggacaccaaccattacagacttcccacctgccttcctggaggagatggccttcggcttttcagcaggaccttgaaaagataggtagacagatggcagggaaggtgttccagggagagaagggtaggacccaaggtgtggaagtggaaaacacagtcaccttccaggatcagtaagtgattctacttggcaagtggttcagctaggtatgtgacgaagtagccacagaaaggctggaaaagtgcccaaacacggagggccacacaggatggccatttcctgtggagagaggaagctaagaggggtgcttagtgaggagggggagctggcctttgaggctccccaggaaggtgcagaactgatgcagggcccccgagactgatatggatgccagccccagtcagaggcaggtctgtggagggcagaggaaccctccaccccatcagttctctcttctcctctcctccaccctagatgggatgctctattctggtactatgaacaacttcctgggcagtgagcccatcctgatgcgcacactgggatcccagcctgtcctcaagaccgacaacttcctccgctggctgcatcgtaaggacctgacccccgctggcctcctttcctgagtcctggtgaccttgctaattcactcaactttcatttgcggaaggtacaatgtgtccattactgttaggcgcagggggtatatggcagggaagaaggcaaagctccggttctcttgaagctttcgtcttatgtaaacacattaaagaagtaccagtcatccccaccccacatcgctacccctcgacaagctgtgggacccgaggaagcctgtgtgtcctggcctccagggccaaaccaacggttttcactcaggcaaacccagggcatgcaggggctcagtccctaagcccatctgcccctcccccgcagatgacgcctcctttgtggcagccatcccttcgacccaggtcgtctacttcttcttcgaggagacagccagcgagtttgacttctttgagaggctccacacatcgcgggtggctagagtctgcaaggtccgcggcctgggcggggggcggggctaactggaggagaaccaatagggagatggcaggggcaggactgagtggtgggcccccagtgagagcgggggagcggggcggggaacaagcgggcctggcggggtggggcgggggacagcggggctgggcgggtggggcgggggacaagcgtggctgagggggcggggtggggacacgcggggctggcggggactggggggacacgccgagctgcggggggcggggaggacacgcggggctggggggtcggggcgcccggggcgccccctgactccccctgtgcccccagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctacgcagtcttcacctcccagtggtgagcagcagggctggaccatgggggctggacacgggacttgacgccagtgaggccccagctcgtgagcggaggcaggaattgacatgagccagcacctactcagcactttcacataggaaggcattaaatcgtcaccacctctcaggaatttgactcatgccctttttgtaaatgggaaaaataagacgcagagaggttctaactagtttatattctgcctagttccaaaagggataggaagcattttacaaaaggcaaatattaaaatcgataaaatagatacagaaatgggaataaaaggagaatatgagaagccaagggtaaggccaacacactacaaatgcttgtcataagatgtaggatagtccctggatgccagccacaaatttagctctgcatttcctaatggccagggcaaacagggaaacgctatccgtatcagaagataaaaataaagtcggccgggtgcggtggctcatgcctgtaatcccagcactttgggaggccgaggtgggcagatcacgaggtcaggagatcaagaccatcctggccaatatggtgaaaccccgtctctactaaaaacacaaaaattagctaggtgtggtggcgcatgcctgtagtcccagctactcgtgagcctggggcaggaggatcccatgaacccgggaggcggaggttgcagtgagccaagatcgcaccactgcacgccagcctggcaacacagtgagactccgtctcaaaaaaaataaataaaaataaagtcattgcttgaaggttgagaaaggttaaccaatttgtccaaggtccccgagtcatggtctggccccacagtgtttaggtacctgctgacaatgtgtcaggtaccaaaggtatttggggtaagtgggatctggtatccacaggatccagaattgagagcctggtgtatacagtagtcagcttcaagagagcagagaaacagacctcctgtctccacagaccagggttgaggaataataacagtctggtagtcaggcactggtcggttctctgaggaccagggatccaagagactcaaaggaagaggggtttgtgtggagccaggctagagctggttacactgtccctccaatgggtgcagcccagtgtaggcaggacaggcaggggccaccccagggcctgagccccaattaattctcattaaggataatcagacttcagatcccaagatgggcctagagccaggccctgggccagagtcagggaattccatggggctcccttggcccttatcaacacagtgaggggaaggagtggtagctggaggctggcccagctctccacactcttgcctcctgggttttctcactgagggccagcgctggagagagagctgctggtgtggcagagaccacagacaatgttccctctggctgtctccaggcaggttggcgggaccaggagctctgcggtttgtgccttctctctcttggacattgaacgtgtctttaaggggaaatacaaagagttgaacaaagaaacttcacgctggactacttataggggccctgagaccaacccccggccaggcagtgtgagtactaccccccacactgagcacagtctacacatacataatgtgcatgaaaaaacacctatcatggcatagtaaatgcccaataaatgttagtgctctccaccccaccaatctcgcctgctcagacgtacacctggtatagctgcctatattccacatgtgcctagcacccttttatacacggagcagttgctggagccatctcccttcaccaaggctaagtgtacaccaaatatctgggtatatcactatggaaacaagggaacatgcgctgtgtgccaaggactgtcttgggcattgccacctgcatttatttaactttttaaaaaaatcagaggccagggccgggtgtggtggctcacacctgtaatcccaacacttggggaggccgaggcaggtggatcacttgaggtcaggagtttgagaacagcctggctaacatggtgaaacctcatctctactaaaaatacaaaaattagccaggcatggtggcacgcgactgtaatttcagctactgggaggctgaggcaggagaatcgcttgaacccgggaggcagaggttgcagtgagccaagattgcgccactgcactccagcctgggtgaaagagtgagactcagtctcaaaaaaaaaaaaaaaaaaaaaaaaaaaaatcagaggctgggcatggtggctcatgcctgtaatcccagccatttgggagactgagacaggaggttcacttgaggccaggagtttgagaccagcctgggcaacattgtaagactctgtctctaccaaaaaaaatgagctgggcctggtggcatgtgcctgtaatcagctactcaagaggctgaggtgggaggatcacttgagcctgggagttcaaggctgcagtaagctatgatcacgagaatgcactccagcctgggtgaccagagcaagatgctgtctctaaagaagtttttaaatgaaaaaaaaaaaaaaaaaatcacagcctgggcaacatggtgaggcaacattttctcctctacaaaaagagaaaaaatcagagctattatatgtacatgatttgaagaatcaaatagatctaaaatgaaatagatctatagggttgactataaaaagcagtcctatttcccatcctccacctctccccaaccattttcaactcttttagctgattcttttcaaatttatctcaaaatttctaaataacatgatttattgctacttcgtgacgtttcagtttcagacagtatctgttgaattcccactgtagaaagtgaggatttaactatgttccccaacccccacctccacccagtggtgtgctagagctgacttgcagcagccagcaagaactgtttttgcccatctttttccaaatttgtgtttagtgatactacactggtagcttgaaattagccatggtggaagtatacatcacggaaatcagcaaacaatgcaaatcggctttctaaccctctcccgcaaaagctgacttggaccaacatacagtaactgcacccacccccaatctcctaacgtagttttctagtaattttggttagatcaatatttatattatgactcttcttattcacagcctagccaggcagtaagccatgattacttttcctttttgcatagttttgttttccctggggttagtaattatcttgacttttctgcttgctttgttttctaagctttttatttatttttatttttattttttttgaaacagagtctcactctgtcgcccaagctggagtgcaatggcgtgatctcggctcgctgcaacctcggcctcctgggttcaagcgattctcctgccttagcctcccgagtagctgggattacaggtgtgcgccaccacacccagctaatttttgtaattttagtagagatggggtttcaccatgttggccagactggtctctaactcctgacctcagttgatcctcctaccttgacctcccaaagcgctaggattacaggcatgaggcactgtgcctggtctaagctcttatctttaatccaaccccaaactcttcttaaattatctgaatctcttctgaagacagacctattagcttttctaacagtttcatcttcctggagagcctttctgactgctccagtctagactagtgccgtctactcccggagcacagatgccatcctggaattcccctgcctcatcattctggggattccctttgcctctttcctgtgacagatctcttgtttcttgtgtcccatggcttcctcttttttttttcttttttcttttcaactatttcattttggtggaggttatcctttgtagattcctggaaaaggatacatggcaggtaaaacattttaagatcttgagtgtctgaaaatgtattctactttcctatttgatagttcagctaggtatacgtaattctagaatagaaatacgtttccttcaaactttgaaggccttgctctattatcttctagcttccagaggtactgttgagaagcccaaagttattctgatccctagccctctgaatgtaacctggttttatttcactgaaatcttttttttttgttttttttaatactgatccttgtggagcagggctaccttataggcagtgtacctcactgccctcactggaatcttatagtgctttttctttgtcctggtgttctgaaatttcatggtgttgtgctttgatggaacactactcatttattgtgctgggtactcaatgggccacttcagcctggaaattagttatcttagttctttcagttctgagttttcttgaactatatcttcctatcttctttttttttttttttttgagatggagtcttgctgtgtcccccaggctatagtgcaatggctctatcttggcttgctacaacctccacctcccaggttcaagcacttctcctgcctcagcttcccgagtagctgggactacaggtgccctccaccatgcccagttaatttttgtatttttagtagagacagggtttcaccatgttgcccaggctggtctcaaactcctgacctcaggtgatctgtctgccttggcttctcaaagtgctgggattacaggtgtaagccactgtgctcggtctttttttggtatttttagtagaaactaggtttcaccatgttgcccaggctggtcttgaactcctgagctcaagcaatacacctgctttggcctcctaaagtgctgggattacaggtgtgacccactgtgcccggccctatcttcttttcattcaacaaatattttttgaggacacatgctactattctgggcagggaatatagaagtgagcaaaacagatgaaagtcccttgcctcatggggcttacattccaatggggtgttttctcacttttttctggacctcctagactagtcttctcactttttttaagctttcctactgtccaagtctttggttgtgttctatttttctggaagagtgtctcaactttgtcttccaatctttctgtcaggtttttcatttctgtgttcagagacagtgaaagaaaaaagaaagaaggccaggtgcagtggctgacacctgtaatctcagcactttgggaggctgagacaggtggatcacctgaggtgaggagttccagaccagcctggccaacatggtgaaaccccgtctctactaaaaatacaaaaatcagccaggcgtggtggcacacacctgtagtcccagctactccggaggctgaggcagaagaatctcttgaacccaggaggtggaggttgcagtgagccaagatggtgccactgcactccagcctggatgacagagcaagacttcatctcaaaaaaaaaaagaaaggaaagaaagaaaaagatttttcgtttctgccaaacagtctcgacctcctgggctcaagtgatcctcctacctcagcctcctgagtaactagaactacaagcacccaccaccacacccagttaattttttaatattttgtagaggcagggtctcaaactcatgggttcaagcaatcctcccacctcagcctttcaaagtgctgggattacaggtgtaagccaccatgcctcacctgggattgtatagattaaaagaaatttaagaccaggtacagtggctcgagcctgcaatcccagcactttgggaggctgaggtggaaggattgtttgagcccaggagtttgagagcagcctgggcaatatagtaagacccccatctctacaaaatatttaaaaattagctgggtgttgtgccacgtgcctgtagtcctagctacttggaagggtgaagtaggaggatcacttgagcccgggaggtcgaggctgcaccccactgtactccagcctgggcaacagagtgagaccctgtctcaaaaaaaaaaaaaaaaaaaagaaagaaaagaaaagaaaaagaaaaatatttacataatccctttccatcttctatttttctcgtgcatttttttgcttgtcagagtcttccacagcctggatcttgatgattgcatctctgtagtgtagtttaagtatttcctgtaaattgttcagtagttggatctagagacttaatcggattcagatttggtttggaggaggggcaagattacttcatcgtggttgtgtgctctttgttctggatgcacgtaatgcctggcagccctctttgtgtgaaggaaagactcttctttggcagcattcgcttcctgtttcatggatgcactgttttcacatatctctcataggatagtaatgatggatttctgtgaagttttcttctttctgattcatttctgtttcctcttagtttttttgtttgtttgttttttgttttttttgagatgaagtctcactctgttgcccaggctggagtgcaatggcgcgatcttagctcactgcaacctccacctctcggctttaggcagttctcctgcctcagactcctgagtagctgggattacaggcgtgcgccgccacagcacccagctaatttttgtatttttagtagagatgggatttcaccatgttggccaggctgatcttgaactcctgacctcaggtgatccacccgcctcggcctcccaaagtgctgggattacaggcatgagccactgcgcccagcttactttttttttgtttgagacagagtcttgttctgttgcccaggctggggtgcagtggcacgatctcggctcactgcaacctccacctccctggttcaagcgattctcctgcctcagcctcctgagtagctgggattataggcgcccaccaccacgcccagctaatttttttctatttttagtagagatggggtttcaccgtgttggccagactggtctcgaactcctgacctcaggcaatctgcccgtctcggcctcccaaagtgctgggattacaggcatgagccaccatgcctggcctctcaggtttttgttggttcttcttcttcttcttttttttttcccctatttgtttattttggtttccttcatgttggtggttttacttacatgtctggtagtccttgaatgtgtactcatatttaacagtgggagaccttgaagctgtttggagctctgtgtccataactaagtcttggcaatttggtctctgttatgtcaccactgagggtggtctggctgggctgtttggtgggaatcttcaatgtcagtatctttactgtatcttaggtcattaagtctttcctcttagacctccagtcagtttcccagagcagcctcttctagtcttctgtgcagaggcagatgatctggctcttggtgtctgggagccacaggggaagagggttgggtttgggaaagagtctcatcatgtagtgtacttaccttattgaatccccctctttcaggatggtgtccccatcaactgggcctgctatcctccatccagaaaccctctgttttactctctctggtggataaacctccagtcttgggccaggatgtggaaggggcagtcacccagctctgtggagtttggagagtacctgcctgtttcttaaacagactttcaaataatcctccttatttagcatccccattaacctcacttccagaggttgctgagattagtaattcgtgaactttaggaatcctgccttccaaatgttttggggcttcctccagggctggcttgagaagattcttctctctctctctctctttctctgttaagtcttttctatttgttcattcgctttccagcttccaaaatgtggatgcttttgcatttctctcttgttctccccatccctccctcatctaggtttatgtcttttcttttcttttttttttttttttttttttttttgagacggagtcttgctcgctcagttgcccaggctggagagcagtggtgcgatctcggctcactgcaagctccgcctcccaggttcatgccattctcctgcctcagtctccggagtagctgggactacaggcgcccgccaccatgcctggctaatttttttgtatttttagtagagatggggtttcactgtgttagccaggatggtctcgatctcctgacctcgtgatccgcccgtctcagcctcccaaagtgctgggattacaggtgtgagccaccacgcctggctggtttatgtctttttaaaaattccctggtcgggcgtggtggctcacactgtaatcccagcactttggaaggccgaggcacgtggatcatgaggtcaggagatcgtgaccatcctggccatcatggtgaaaccccgtctctactaaaaatacaaaaattagctgggtgtggttgtatgtgcctgtaatcccagctagttgggagactgaggcacgagaattgcttgaaaccgggaagtggaggttgcagtgagccgagatcgtgccactgcactccagcctggcgacacagcaagactccgtctcaaaaaaaattccctttggcccaggtgcgatggctgatgcctgttatcccagcactttgggaggccgaggtgggaggataacttgaggccaggaattggagatcagcttgggtaacatagtgagacccccatctctacaaataataaaaaattagctgggtccaggcgtggtggctcatgccagtaatcccagaactttgggaggcagtggtgggtggatcacttgaggtcaggagttggagaccaccctggccaacatgttgaaaccccgtctctactaaaaatacaaatattagctgggcgtggtggcgggtgcctgtaatcccagctacttgggaggctgaggcaggagaatcgcttgattctccaggcggaggttgcggtgagccaagattgtgccactgcactccagcctgggcaacagagcgatactgtctcaaaaaaaaaaaaaaaaaaaaaaaaggccaggcgcttgtaatcccacagcactttgggaggccgaggtgggcagatcatgaggtcagatcgagaccatcctggctaacatggtgaaaccccatctctactaaaaatagaaaaaaattagccaggcgtggtggcgggcgcctgtaatcccagctactcgggaggctgaggcaggcgaatggggtgaacccgggaggcggagcttgcagtgaaccaagatcaggcctctgcactccagcctgggagacagagtgagactccgtctcaaaaaaaaaaaaaaaaaattagccaggcacagtggcacacacctgtggttccagcttctcaggaggctaaggtaggaggatggcttgaggccaggaggtcaaggctgcagtgaaccaagatcatgccactgcactccagcctggatgacagtgagaccctgtttcaaaaaacaattttttaaaaaaaaaaccctttgacctataatcccagcactttgggaggccaaggtaagaggttcacttgaggccaggagtttgagaccagccttggcaatatagtaagaccctgtctctatttgtaaaaataaaaaacaacaaacaaaaaaaccctttgggaggacatgagagtaggtgcatgtgctcattctggcatcaaaatgagatgtagatgttattacctattttgcagatgaggttgaaggtcagagaggtgaaacagcttgtctaaggacacagcttataggtgacagagttggggctggccctaagacagtgctcttggagaacaaggatcctgactgaagatcaagacacgggtgtcccagagccacagcatcctcatattagcagggcctttagagaacagttggtccaaccccctcattttatgggtgagaaaaaggaggctcagaatggagaagggattctcccagagtcatgcagcaagttcgtgcaaaaccgtgaggagaaatgctccgtgctacaccacccctttctgtgacatccattcagtcattgactcagcaaacatttattgagcaccaactgtgtgccagatcctgtgctatgctgggaaatacagacatgagtaaaacttggtccttttttaaatttcttttttgagacacagtttcactctgttgcccaggctggagtacagtggcacaatcttgggtcactgcaacctccgcctcccatgttcaagtgattctcctgcctcagcttcctgagtagctgggattacaggtgcctgccaccatgcttggctaatttttgtattttttaattaattaattaattaattaattaatttatttattttgtttttgagaccgagtctcactctgtcgcccaagctggagtgcagtggcgcaatctcggctcactgcaacctctgcctcccgggttcaagcgattctcctgtctcgccttcccgagtagctgggactacaggtgcctgctaccacatccagctgattttgttttattttttgtagagacggggtttcaccatgttagccaggatggtctcgatctcctgacttcgtgatccgccagcctcggcctcccaaagtgttgggattacaggcgtgagccactgtgcccggctgtttgtttgtttgtttatttatttatttatttatttatttatttatttatttgagacggagtctctctctgtcgcccaggttggagtgcagtggcacaatctcggctcactgcaacctctgccttctgggttcaagtgattctcctgcctcagccttctaagtagctgtgattacaggcatgccaccacccccagctaatatttgtatttttagtggagacggggtttcaccatgctagccaggctggtctcgaactcctgacctcaggtgatccacccacctaggcctcccaaagtgctgggattacaggtgtgagccactgcgcccagccataaaacttggtacttgcctataaggaggcttcgtcctgcttcctgctggctgccaggcctccttgctggaggtgcaaaggaggagaacagtaataacagttaacatttgctgagtgcttgcttcatgccaagcactgtttgaattatttttcatgtattagtgcatttcattttcccagcgagcctatgaggcaggtcttggtaataggcccacttcacagctgagaaacttcaggcatgcagaggctgggacgcacaatcaggcagctccagagtcggagctttaaccaccaccctgaaatgaggactgccatgagggagggggtaaagggagaagagcaggcgttggagggagggtgagctgaggggaaggggcaaaccaacctgatctgcctccctcctcctttagtgctcagtgggcccctcctctgataaggccctgaccttcatgaaggaccatttcctgatggatgagcaagtggtggggacgcccctgctggtgaaatctggcgtggagtatacacggcttgcagtggagacagcccagggccttgatgggcacagccatcttgtcatgtacctgggaaccagtgagtaaagagttccgggacatcccccagaggactagagcagaggatgcccccaggttgaggagggaaacccttgagttcattcacttattcattcaacaactgtttactgagcacctgctatgtgcctggcattctgctaggttctggaaatacagcagaggagcaaaacagtccactccctaccctttctgagcttcctatggtgggggaggcagacagggaggtctttggtggctttatcaagagctgtgtgtcttatgagggaagctatgttagaggaatgaaaggtgagtgggtggaggggagctggaaaccgcacatgtagagatcactccttcaggaagctcgtctgtgaagggagagaggaaggaggtggtggctggagcacggagtggggcgcagctggggttcttggttttgttttttccccctccttgcccccagggttcttgttttgtagacaggaaggactaagcatctagtagacagggggatggcaaagagatgggtagaagaagggataagtggcaggtaaagttgtggcgggagcaggcggccagagtccaggacacatgtcgagctgggcagctgtgggtggcgggggggacagcacctgagctgggctgggagtgaagctgtagcagcggggtgtgacttggtgggtgtgcaggctcagggtaggaagccaagggagctcttatttgaaggcttttgtgttctctatgtaggtggaggacacaaggtcatgagctgggagtgagggggcaggaaaggtgggaggtttgaggagagagaggtagattcaaatagccattgtgggctgggcacagtggctcacgcctgtaatcccagcactttgggaggctgaggtgggtggatcacctgaggtcaggagttcgagaccagcctggccaacattgtgaaacccgtttctactaaaaatacaaacaaattagcagtgtgtagtggcacgcacctgtaatcccagctactcgggaggctgagtcaggagaatcacttgaacctgggaggcagaggttgcaatgagccaaaattgtgccactgccctccagcctgggtgacaagagtgaaaatccgtctcaaaaaaaaaaatagccattgtggaaagagggagacggagtcagcagagaatgcagcaagactgcccaggcagactgctcaggcaggataaccttgagggtcagtggaagaaatttgtcaagttcattcattccttcaggacagattactaggcactgtatcagctgtgcatgtattgggtatacagcagagaacaaaacagtcaaaaatctcagtctttgtggagtggatggagacagacaatagcatcctgaataagtaaattacatggcacatcatgagatttgagtcacgtagaggtgtgtgcgggggaatcaggaatgccaggtaaggaggttgcacctgttaaaagggtggccaggtagacctcactgaggtgcttgatggatgtgagggaggcaggtgatgtgattttctacagaagcacccagccgcccactgtttcatgcctatggagaaatagctgggtttctccagggacaaagttttgtcagggagttgcaaaggaaggacaggggtccaagggattttagtcatttacaagagactgccatctccatggcacagaggaaggtgaatgatctggctgacccgcgcccagtacatatcaccctcagaaggagctttcttacagctggggaggcccccggaagttgggaagggatctgtggatgagatgagatgacttccactctctctgtctccccatagccacagggtcgctccacaaggctgtggtaagtggggacagcagtgctcatctggtggaagagattcagctgttccctgaccctgaacctgttcgcaacctgcagctggcccccacccaggtgggaagggacctgaccatcaaatggccttccagtggggctggccttgggggcctgttgggctggctccctgggcctgcaccagcgtgctgggactttactagatgtggctggggctccctgacaatctccatctctcttccagggtgcagtgtttgtaggcttctcaggaggtgtctggagggtgccccgagccaactgtagtgtctatgagagctgtgtggactgtgtccttgcccgggacccccactgtgcctgggaccctgagtcccgaacctgttgcctcctgtctgcccccaacctgtgagtgccagtcctggatggtggcctggatggccagccaggacccttctcagccagcttctgctactgttcttcctctctccaggggctactgacatattcactccaagagtcctcccatcctgcagtgggttcctccagggatggagtttccaggcagttttgaagctgctctggccattccgcgttcctctctctgttcctagtctcccctggcctaccttcttccctactgcacttcctcccttcctccttcctcttcccactttcagctcttttgaaggataatttttactttctctgctctcttaggaactcctggaagcaggacatggagcgggggaacccagagtgggcatgtgccagtggccccatgagcaggagccttcggcctcagagccgcccgcaaatcagtgagtgtaggaccactcaccaggggaggtgcaaaggctctggaagacttttgggcaggggtgggcattcctgctccaatttcctcccccagcacctgcctggcttgagatctgaacacccgagttgggatggatttgggtcctggctatagggaagaggcatag

SEQ ID NO: 36 - DNA, 193636 bp, Artificial Sequence
  Synthetic BAC sequence
cttcctttaagcgatcttgaaaataagcccttgcttattttcaaatgaataaatgtgaacccagaataaatgtgatttgtaaagttctcataactatcacatgtatatattctactatttgggttttttccacctagtttttgccattacaattaatgttcaaatgaacatctttgtacttcattgtgacattttgatctatggctcaaagtaagaaagtccactgtctttttgaaggccagaacacagcagcctgtacagtgctgtttgcttcctctggaatgttcttttcatttccagctttgcacttgcatccacagacaccattaacctgaaatgtgatggggatggacaaagtggatgatgtttggcgagcggcctctgcctggcttgcctgcctcggttcactgcagtcagcaggtgtgagaaggatttttctgtctattttaaggcccctcactgaaaatgggaaaaacaagctcgtttgtgcgggggacctcaagccaacacaagagcccagccaccctgcagcagcctgagcgtgacagcgttctgccccataaagagatgctaggaaaacacttttaatggtctctgcctagactctgtttacggaatttatttgccagagctcaggccattcagcagtaccttggcagcagggcccagcaaagctgcaactcctgtctcccctccacgtctgcctgggtgtattaaacccccttgttctgaacaccccagagctagtacccgaaaggcaggagtggggggttgcagggaagaaaagccatgggttgtaggatatttggggccaatataaacttccaaattcaaaaacaaaaactagctaggctcggtggctcactcctataatcccagcactttgggaggcagaggcatgtggatcgcttgagctcagagttcaagatcagcctgggcaacatggcgaaacctagtctctactaaaaatacaaaaaattagtcaggcttggcagtgtgagcctgtagttccagctacttgggaggttgaggcaggagaaattgcatgagccagggaggcagaggttgcagtgagctgtgatcacaccattgcactccaacctgggcgatgggagtgaaactctgtctctattaaacaaaaacaaaaccaacaaccaaagaacaacacaaaattaccctccaaagagctaggggcatgagctactgttggctgctagctgtggccgtttccagccagcagtagaaaggaagatgtaaaatcctgaagcattttgagtactgctttgttttttttctttcctgtttgacgattgatgctgaaccatctttaaagtgtggtttttttgtttgtttgtttgttttgttttgttttgttttttgagacagagtctcactccgtcacccattctggagtgcagtgatgcagtctcactcactgcaacccccgcctcctgggttcaaatgattctcatgcctcagcctcccaagtagctgggattacaggtgtgcgccaccacgcccagctaaattttgtatttttaatagagacagggctttgccatattggccaggctggtcttgaactcttggcctcaagtaatctgcccacctcagcctcccaaagtggctgggattacaggtgtcagccaccatgcccagccccaaaacttacttttaattccttttctcattacaaaaataatatatgtcaatggttgcaatttccaaaacaattttaaaaggggaaaataaaaactgccaatgagataaggataaacactgttaacactttggtctgttgcccttttgtagtttgttctgcttctagggagagaattgtaccagcctcgactatcatcttccttgcccagacatcagatatcatttaaaatggaaacctgtgggttgtagaatcccccttggactgggaggcagaagacccagtttcttgtgttaccacttggtcctgtggccttgggaaagccacttaaccttgatttgctcgtctttaaaatggggactcagtattcctcaccttagcagatggagtggccaaaggtgtttctggcagagagtgctttgcaaagtgctgtgcaaattgctggccagttttgatgtgggtgtgtgagcctttggttggacaaatggccagagtagttttcctgtcttcttgggggaactgtgaccctttctcgtaaagctgttctgtctctgatcctggtgaacatcaccagcttcctctagctgcccagagctgcccctcccctctgccctgccgtgtggcacctggcccagtgcagtgtccagtccctctccaggtcccgatgcctcggcctccacagtatctcctagtctgcccctctcgccccatctccaccatttccacttgatccttgtccctgcctgaactcctgtgtcagctccttgctccctccaggcgcacctacttccaaccaagctccatgcagcagccaggaggctctttctgaaatgtcagtctgctctcgccaccacctgcttcagtagctttccactgctgtcaggacagagtccagaggtcttgctgaagctgaccaggcccggcctctccgcccttgctgactgcttcagcttcacccctgccgctcatctcctgacttagccattccttcatgtttcttcttttctccaggcctttgcctgggctgttccctctgctggatacacttccctaaccctgcttggtaatcaactcaaccttagtcccctgcttcataggtcacctcctccaggaagccctccctggtgacctcacctagtcagggtttgctccccaccctcatgctgccactggccccactgtggttgtctgatgactcacctttgtcttctgtttggctgtgggctctgtgagagtagagcctgggtctgcctgactgtgttttgccagcacccagcatgagtgtctaccctgtaccaggcacttgtagaatcttgtttagatattttgttctcccctggagatggaaaaacactcaatcttcccaagtgttagactgattgctgatgggtcttatttttctctctgagttcttttaagagtcctggaaatgtggactgagaacagctgtcgcatgtcagttccgaagtagccgcttttatcagaaacggtttagagagagattcctagttgcacctcccgccaagggcagtgaccccacttttctctccccttgcaggcccctatccgacctcaatgggaggcgtgggagagttatggggagtacatcccaccggcacagctgtcatgtcagccctgtctggctgccggagttcgactggtcaggcgagatgggcacaggcacggctctgctaaaggccttggctgagcccagcttggggcagagcaagccactgagaatggctttgccagaagactccgtcatcaggcttgggtgtccacagccttggagtgctgaacagctggaacatcctgaggcatgtggcgggtcagttgggacaaagccattgagctgctaaaccaaaccggtgctgctggattgggacggagacagcagtgaggaacatgagctccagtgtcagagggacctggttttcatccaggctctattccttactggttgtgactttgagcaagtgattagatttccctgaacctcagtttccttatctgcaaaatgggaactggagtgttgcaaggattgagtgaagatctgcatggggagggctgcgtagggtctggcctgcagcaagtgctcatgcagcatctgctttcccgtcttcctcttcatcctcacagccgttcatcatcgtggttgtcatcaaccgtcccgtgcggtgcagagctttgcttcttggttctgcctgcttggtggttgccaggtcccgccagcttaagtttatctgttcgttcattcattcatttatctgttaagcccctcttccttcttccaggccagggagccagggtgctgccaggtggtggggagcggctttcagaagtggctcttggcagcgcaggctgggctacatttatggcctttatgtaacccctttgccctgagccccattcctgcccctcagatctttatttactgactctcggcagacttagaggtcctgaaaggcaccccccaacgccctcatctcattcatccttctgcctccaggcaggagggtcctcagccatggcagacatgtggggtgatagccaatcccagccatgagcccctattcagctttcaccctgggcaagatcctgtggagggtcccagtgtggggctgggggagggatgtgggatcagctgagatccttaggaagctgtctctagttgggaagacagcagaaagccaacacgtgacactgggtgacagccctgtgcaagtgtgcaaggcgggtggctgccaaggtccatcttcagtactaagagcccaagggcggggtggggaagggggacagagacatctgtgtggcagggaaggtgccaagtgaacagatgagagagagagagagagagagaacacttttgggtcagcaggttcagcgttatccaaccagcaaacatttcctggatgcttactgtgggccaggcaccaggctatgtgctttgcagacacacactcgtccaatcactacaaagccctgtggggcaggtgctgccttccccacccctattttagggatgacgatgcagagactcagagaggttggtaagttgctcacaggcacagatctctgaaggaagtggagcctggattcacacctgggcctgagtcgaggccatgctggctgtggatttcctccatattggccatggcttccccgtggacgtggaacaatatgggcatgtttgggagaggaggtgtattctgctttggtgggctctatgcagaggtcatgaggcagaaggtcaggggaggctgggttgggcccgggacaccagccatgcctcctgtctgaaaggtgaggtccttgccccgcagatagtagggatccattgaatgttcatctctgatagccgctgtctgcagtcatcctcagggagagagcagagagcaaagggaagccatggacagagcaggcgggcttccaggctatatgagatgcagttcctccttctccaaattcttattaacccactgtgtacggcgtttctcaagtatccagcccaggacttgggatgtaccataaacagcctccacttctgatgacggtagcgctaaggctcaggtaatgccacaggaggcaggagcggctggagcttctctctcctgcagtgtcaggccagagcaggtttttcttttttctttttcttttttttttggcggggggtaacagatccttttttattttttatttttttggcctatgcagcagttattttattttattttttttcagtatttttattttatatttatttttgattatactttaagttctagggtacatgtgcacaacgtgtgggtttgttacatacgtatacatgtgccatgttggtgtgctgcacccattaactcgtcatttacattaggtatatctcctaatgctatccctccccgcttcccccaccccacgacaggtcctggtgtgtgatgttccccatcctgtgtccaagtgatctcattgttcaattcccacctatgagtgagaacatgcggtgtttggttttctgtccttgcgatagttcagagtaggtttttctttgtgacgcccggtcgcaggatgtctttcagcaccacctgtcagagctctccaagccggcagctgttcccgctgcccacctgtcccttccctgctctttttggggatggtttctcgctcccctgctgtctgtcctctctttcccctccccctgcagggccttttggaaggtggcagatgggcatgaatgtcacactggctgtctctttgcctgtgctgtgcgtggggccgtctagcccgagagatcagctcaggcatattccaggtgcggcttatgttggtgagaagttctcataacctgagctgatgggggtcagaatgtgcgtgtggggtgcagagggagcttcccacccctggcagtcccctgccctcctcccttggccagccagccacaagacccacccttccttccttccttccttccttccttccttccttccttccttccttccttccttccttccttttcctccctccctccctccctcgctccttcctttctttttctttttttctgagatggaatctcgctctgtctcccaggctggagtgcagtggcgccatctcggctcactgcaacctccacctcctgggttcaagcaattctcctgcctcagcctcccgagtagctgagactacaggcgcccacaaccacgcctggctacttttttgtatttttagtagagacgggatttcaccgtgttagccaggatggtctcgatctcctgacctcatgatccgcccgcctcggcctcccaaagtgctgggattacaggcgtgagccaccgcgcccggccacagactcactttcttggggtttggcaggtcagcaggttttgtgctcatttggctttagcatgagaggagtggttcccagccccgcaatccagctgcagtgttaacttcccactcatctgttacctggatccctgtttcccacaggggcttcctagcctcaccgggtagaaacttcagaattcgcccatgggttggatctgtcccctcttctccatccttggtacttgtcttcctgcatggactggtgcagtagcctcttctttggtcctctgtttctagctggtatcttttttcttccttcccatttattatgactttcttgcttgctgttcttaacactcagaagattcttgacttctctgaagtcgtgaaacttgacactcctagcagatatcaagggtctgtccactgcctatggttccttcaccatatacttcccctccaccccaccctgccagcagacttcaggcccttggggaaacccagcagcagcatggtgggtaatagcgtgttttccaagttatggtgtcaaatctctgctcttctatttaggagctgtttgactttttttttttttttaaacctctctgaactgcataaacagaaaaaaacagattttcttcttgcttctaggtctttggtacagctgcatcctctgtcctctccacctggccaagctttacctccaatgtcagtggatccctgtcccaaataaccacccaccccctcccccaaggccctagagcattccacatgtgtccccaccaaacattcccaaggaacccttgccatggggagcaggactaggcttcaggtgtctgttttcctagaaggtgcgtgtgcctcctccacctttgtaagcctaacccctgttacaatgcctgggctctgcgggagcccagaagtgtgtacaaaaccagtgagcaagcaagggaatcagtgaggaaggggaaggaggaatgaatgatgaggcagcatcgccgcagcggggccgaggagaggtcccccggagcatgcccgtgcagccctaggggtagctcctccctggagcaggtatagctcaccccctagcctggcagccctgtcttcacacctccacagtctacagggtttcggcatttgcttcagttatttactgaccatgatctcctaggtcagatttatcatttactgggtcaggaaagaaaaagccccatggggccaggtttatagagattaaatccactcatgccgaagctggcttcctgcttgggggatgctgcagtgatgcctcaggcctgttcctggagcccgtcagtgccggctgctctgggagtggcctgaggtctctctgggacatgtgggctggagctgcaagctgggtgccttctgccagctgcacgtgccacctggctggccatcagaatgccatcagagagggctggctggctggctcctgggcctcccaggaagaccatacagggactggagtcctccctgctcaccgggtcccccaggctccggcagaggcaacgggaggaaccagttgatcagaaagctgagcagattgagctggcctttcttgttagtttcctccaacagtggtcccctctgagggcagagctggacaggcctcctctcgggcccgtgtggagggtattgcatagaatctttctcctaggaactgacggaagtaagtcttacggagattagactgatttgctgtgttttgagttcattttctccacccaggcatcaagatatggttacgatttctgggaaccatttccttagactgctcagtcctgagggctgaggtgtggccggcacctggtttatctgagagggcctgggctcatgcactctgttgcctctcggccttccacaagagtctgcagggattctctcttattgatgggacacagattgtcctcagccaggccttcatgaaacaccacagtatttcatgtatgtgtgtgtgtgcagtgtgtgtgtgtgcacatgcaagtttgtatgtgtccgtgtatgtttgcaagtgtgcatgtgtgtgtatacatgcaagtttgtatgtgtccgtatatttgtgagtgtgcatgtgtgtgcgtgtgtgtacatgcaagtttgtgcccatgtgtgtttgcgagtgtgcatgtgtgtgcgtgtgtatacatgcaagtttgtatgtgtccgtgcatgtttgcaagtatgtgcgtgtttgtgtgtgcatgcacgtgcacgtgtgtgtgtgcacgcccatcaccagactgtaagtatcctgaaggcaaggtgttggctgtcttaggtcccttccacctcaacagatatcaagggaaatgactctgacctggagacaaggccgggacggcaatggggtgttgtggagagtgtcccaggctggaaccagatggcctgaattctaccacagtccccacttaccagccctgggccttaagccaggcctggttcccggcccccgcacatcgtgcatgagaagcatggcccttgctggaccagtaggcgtgtctgccttgcttcagatagtcatctctgaattaaggaagagctctcctgggacctgagtcttccctggggggcagggacagcttggtaggcagagaagggagcctcacctgccatggttgcagtggggtgaatgccgaggctgccaccacttgtccctttctcctccagtgaccaccccccaacctttccttctccacaaaggaggggcagagtgacctcccataagtgggcttctctcatccgccattgttgttctagcccttctgtctccctcaaggacagggccgtgtctcagtcgccagtgccccagtgtgtagcacagtggctgcacaccgtaggtgcttgctatgtgtgttggcttaatgaggagtccaggggcctggctttgagtttctttctactgctggccacccacatgcatccctctttcttcaaactgctgggaagcccatagctcagtttgatgtcaaaagcaaagctctctttcatctgatgtcatcgggggagctcatttgattttcccctccctcttttgctgtttgtttcctgttctttgtcttttatggaacaattgaacatgtgcctttattggaagatgctgtggatcgttttgggaagtaagcaggcaatgaataagtcagtgcgttagaaacgaaggggagaagaagctccctgctcggcctaggaagcaggcaggtctgagccttgttcctcctctctggagaatggacatatgggcacctgccctgtagaccttgaggaatgagaacagaatgggttctggtggtccagtgtgctgggcagcaatgggcatgtccttcttccagggctctagaaggtgggtctactcaggcaggacgatgctatgtggctcagggaatgggctgtgctacaaccagcctggaagaggccagggcttgctgggcgggcacagctggcagctccccattctggaggaaccagccaagagcatgctgaggcgggccaccagtgagtgctttggggggaccaggtgtcccaagtttgagcaccaggaggccagcgctgttgctttgctcttctccatccttgtccaaaaaaggagttcgctccattaagaggtataaataggagtgctgggggtggccagacgacagggccgctctgctcatatcctcgaccaccacaggagggccgctcttgaagtcctggccagcagcaggagacatctttttaagatgttggcaagaaatgagagttaggcaatcttccgtcaccctccgccctcctcccacccaccgtggccatcataacacagaatttcaaagaatgagctcccagtggggagaggttaaacactgtggatttgttgtttcagggaagaactcgtggccagtgacctgctggagaagaggcaggaggaaggaaggtgccgtggtcagcatgggagggaggcagggaggggctgagaggcaggatttgcagtcggtcaagcctgggtttcctcagcttcattgtcacaaaaaagcagagagggaggacagccgctgaaggcagaggcatggctttgagaggtggccgtagtgatgctgtgtccagctctgtgtctgactctgcccagtggttctggaaggaaagcagtaccttggaagcaggcatgggttcagttccttgcccctccacttactcattagatgtccttgggcaagccctcacgcctttggaggcagttacccgcctgtactgtgggacaaataaataacgcctccccagggggtctccatgggcaccagccaagacctgtgtgggaggggagggcctgtgcactcagggcctggggccttcgggtggggaacatggctcaccaggcctcgagatggtcttgaggggtgggcattgggtctgcctctctgtaggcctggtgacagccctttctggggtcattagcctgcagccagcttttttcccagctaagtctgaatggtgaaagccggatctcccatccaggactgattcagtggccaccacttcctacgcttgaggaaggaagaggaggaaggcctcctatcatcctcagaaccaccacctgcctttggtggttgctcatacgtgggcacctgccatggctattgctgcgagtgtgcctgtcttcactccctgtggaaggtgtgggctgctgtgcagcttgcaaagcgcttttcacactccctgagcccaagttttcattcttgttttacggaccaggctctgagaaattgcctcggtcacccacttataggcaaagcctgagccacgacagcttaaccacaggtgtgaccagctcatggccagaatgtgccacaggatggggtaaggatgcaggctgggacggggctggaggcccagcccatgactgccagatgggcctgttgccagtgccggctgccatctctgatgggaccctccagctccagcccctttcacatgtgggtcctggagtctctggtcccaagcagctaccgcctacacctgtcttattttttcagtgcggcatttagccatgggagggagaggtggtgggagaagtaagttaccttcaagtctgagttggcatgaacttgccaaataaaacatttaatgtattgccaagaaacattttgcttgcttacttcttagcagaccaagtgcacaattttccatcaaaacttttccattgctcaaaagtgtctctgacaccgaggctggatcctgcagcatctttgtcacagctcacattttatttggaatctggtgttttcagaatgtcaccacctcttgctttgcgtttcccgatggaaacatttcacaagaatcttttcagctgtcgaagtggtgcaaccctctttcagaaggttttatttgtccagcgcagagaagaaccccttttttgtgaagtccctgccacgtttcactggtcagttcagatcttgccaggctgccatggagtggatcaaatcccattacagcaaaagctgtttgagtttcatggacacgtttgtggaaacaattgcagactcctctgttgacagtctacttccagtgtgtaatgtttgatagaacatgcacgcagcacagcagaagaatttggacagccctcagaatgtgctggaatggaatttggctgggcctgctgtccaggtctctgatggggctgtgggagaatgtttgcccacccattaggcagatattcaatgggctccgtctgtgttgcagatactgggctaatcacagagataagtgcaacccaggccccaccctcagggagcctagtcagtagggaatggaagagacatctgcattttgttcctaaatatgtcagaatcatgttaggaagtggatggaatgtgttatgcatttattttaatgtatgtcattaaaaaaatccagccactgcaacagtaattccactatgttattacttagaaagactaagttggaaaaagacaggaggggcagttaattacaacctaagttaaagaaagatattgagtaaatactgtaatggtggtaactctttgatatggtttggctctgtgtccccacccaagtctcgtcttgaatcgtagctcccataattcccacatgttgtgggagggacctgatgggagatagttgaatcatgggggtggtttctccattactgttcttgtggtagtgaataagcctcaccagatctgatggttttataagggaaaacccctttcacttggctctcattctctcttgccggccgccatgtaagatgtgcctttcctcttctgccatgattgtgaggcttccctggccatgtggaactgtgagtccattaaacctctttttccttataaattacccagtctcgggtatgtctttatcaagcagagtgaggatggactaagacactattataggtggtaggtaaaaaccatgacagcagctcatgaatgactggtatctggaaaaaataagttcaggtgtattttgtgttgattggttgccaggggctttacctctgttctcatccagtccttgggaaccctggataatggtagtgtcagatggtagtcccaactgacagctgataaaagctcataaagttcaaagaagtgaaatgattcatccaaggtcacatgactagtaagtgagggaacttgaatttggatccaggtctgtcaactcctgatcctgaactcttagccactatgctatatggcaattgatcaaattaaaaagtgatccttccctctgcagagtgtaatccaggaaagcttcctaggggaggtggcctcaactgagtggtaggctttagcaagggaagtttgggtggtaaggtagaatgtcccatgggtcagatacccataattattggctggatggtttgaattatagtgacttaaacactttttcctcatataaataaaatcttgagttaggccatgcgttggctcttctgtgtcatcagggtcctaggctgcttttatctctcgattccactaggtgtctcatgatccaagatggcagatagagctccagccacaatattcttgttccaaagaagtagaaaaagataagagggaaagggtaaaagtacatatctcccaatgtgtgagccccttgaaggagcttttctggaagggaaagctaacaagttattcttgcatctcattggctggccctggttattagggaggctgcccactgtgtgctcagcatatgtgaatggaggacaaacatcctgccctcaaggtgcttacagcagatcgaactgcttctcgttgaagctgtaaaggagactgcagttgagtgggtaagaaaaagcctcctctaaccagacttgcctctggagtggccccaataagctcctgggtctgttttggtttcttcaacacatttatttggtgtttaattggaggggaaagttgcagcgattatgtcacctgcccaaggcagcccctgcccaccatctcatcaacccttctgaaaagacaagagtcactcttggtacaaaccagtctcattccaccacctgccatcctctggtgcaattagagcaagagcccactttccacccgaatcctggattggtgtcatttaagctcagcagagccccgtatggtggtgaccaggcccaagttctgtgcagcttacgggcaagagtaggacctgggcactgtgggccacccgggctccgtcctccctctctctcccctgaggacctgggtttgcttttcacttcttatctcaggagggtatgctggccagttgccagaaatatcaaaagtttggagagttctttaaaatcagtggagccttctgggttgccaatgttgttccggggactggttcagagatcaaatcttgttcatgtgaagaagccctctctgctgggatttgggttcatgtgggtatgaaatgcccttttcactttttgggaattgggatgctagaccatggaaagaatgttcgggctgaaatgggagccaggggtgggatacagcccctgtttctccatttgcttgctcaggagacttactccacctggttggaggcagagatggggagagatggcttctgatgtcctcagccaggcatctgcctttgttctgtaattacctccaagtaaatagtcttggaaggaagtttagagagatgtttcatagggtgttagaaatcaaactgctattaatatactaattacagtaggctcaatacttaccattgaaacaggtcctggagagcctctccttggcaacactgttagacattctgttcttgaaatagaaagtccatattctttggtgaaagctctaaatccaggctttccctatgaacagccagcccttttctttggattcagtaggttcagctgcggcctctggcagcaaaggctgggtggagtgaggtggggagaatttgacgcactcagaaagcagtcagctcagcagaggtgtccaaaggtgctggggccccagaggtcccagaccagctacctgacaatgtcattgtacatctaagcattatttttagcaatgacatcactgctactggttttatttttagattgatgctgcaggtgctgtttggaaatgtcttttttccccacatcacttttgtcctggaagtacccagtatatgagggaaacaaaatggcagccaccccaccaagggcaatccattttttctttcttttttttttttttttttttgaggtgacttatactttattagtgtgacttcattcatttttctgtagaaatattactatgttgattttggggatgtttgatatatatgacatatatagattatatttctaaaatctgataagttctgaattctgaaatacatgtgatctcaagggtttctttatttaaaaaaatgtctataaggtagataacatgatgttttgctatatatgtacttagtgaaatgattgctacagtcaagcaaattaatacatgcatcacctctcatagttacctttgtccgtggagtggggcagaaaggttaagagtacctaaaatctactctcttagcagatttccagtgtacagtacgatattattaactatagttctcatattctcatagtgtacattagatctctagacttatcctacataactgcaactttgtgccctacatctccttttttttttttttttttttttttgagacaaggtcttgctctgtcactcaggctggagtgcagtggcgcaatcatgcctcactgcagcctcgaccttccaggctcaattgaccctcccacctcagcctcctgagtatctggggctacaggtgtacaccgccatgcctggctaatttttgtattttttgtagagacggggttttgccatgttgcccagattggtctcaaactcctaggctcaagtgatcctcccaccttggccttccaaagtgctgggattgcagctgcacccagcccatctcctccatttttaaggctgaataatattccattgtacagttgatccttgaagagcacaggtttgaactgtgtaggtccacctttatgaggatttttttcaaccaaacatggattgaaaatacagtattcaagggatacaaaaccctgagtattggaaaggctgacttttcatatactcaggttctgtagggccaactatgggagttgagaatgcatggattttggtatccatcggggactggctctaggactccccgagaatgccaaaatccatgaatgctcgagtccctgatataaaatagtatatttgcatataaccaatgtaattctcctgtatactttaaatcatctctagattacttctaatacctagttcaatgtaaatgctatataaatagttgttatactgtattgtttagggaataatgacaaaaaaatacaaagtctgtacatgttcagtgcagacacaacaatccatttcctgtcaaatatttttgatccatagttagttgaatccacagatgcagaatccatggataaggaatgccaacagtatatcacaatttcattattttttcatctgttgatgaacacttagattgtttctatatattggctagtataaataatactgctagtataaataatgctgcaatgaacatatgagtacaggtatctctacgaggtgcttattttatttcctttgggtatatatccaaagagggcttgctgggtcatgtggtagttctgttttccaatgtggaaaatattaaaaggtataacccacataaataaaagctcctggctaggtgtggtggctcacgcctgttatcccagcactttgggaggccaaggtgggtggatcatgaggtcaggagtttgagaccagcctgaccaacatggcgaaacccctgtctctattaaaaatacaaaaattagccaagtgtggtggcatgcacctgtaatctcagctactcaggaggctgaggcaggagaattgcttgaatctgggaggcagaggttgcaatgagctgagattgagccactgcactccaacagcttgggtgacagagcaagactctatcacaacaacaacaacaacaacaacaaaactcctttgggatctataataatttgtagaggtatcaaggtgtcctgagtccataaagtttcagagtcactgcagtagagggaagaaaaggacaacagaaacagtgaaacttaaatagcatttcctgagccctgagaaacaaccgatgctatatagttattttttcactctaagataactcaagatagaaacttttaaatctagagagctgataaagtaagataataatacattctgcaggcctaagaaccctgatctggaggatcaagactgggtcatgcatacattgcattagacagcgacacctaatgaacaacaatggtattacaacccagctctatgaaaccagggactagcaagagtaaatgctgtattcagactaaaggacatagataagagcacattctgtcaggcagagtatttcattatttgatattcttagacaaaacaaattctcagggtgtggagggcaatttacaaaatatataatgacagttcatttgcttagaccttcttccttagttaagttgaatgttagtggtccatcagggaatctggagcatagagtagaatcacaatcaccttggacttataagaaataattcaaagactttatagaatcagtctctagtcccagaattttatgtttttaccatgttcgtggctcatgctttcttgatttctggcatcctgtctgatttctgagtttgggctagctagagtcttgtttgtctatcttcttgatgcccaataagatcagcccctttactgtgcctggatttctatatccagcattacctaaatccaactttacacaggctttgggctcttccagttcctcttctgccctttaaccccatgtgtgccccagaaccatccacaaggagatgccaagaatagagaagatgaacaacaacaacaacaaaacagaactgcagcccttctgtatgcttcagtctctagcaggctcagcccaagccactaccgatcccttttctcacaagttttcaatgcaatctacaggaggctttgtattctcatataggaacccttctcaaaactgataaaacgataaaggctttgctttactaaaatttgctgtgccagccctctctttagcaactgaccagtgctgagctatctcatgctacctctatggcattgtcaaagaaggcagggaatgtctttgcccaccaaagaacagcatgtgtgtgaggcccatgctagggaagaaaaaattcttaacaaagtgaggtgtgaaggtggctgggggccaactggaccctggagcccaagcgaagtgaagtgatgccagatgccttgccctatcaaagtaatgaaagtgatctggaaatggtgttttttctcattttaatgacagagcagggctgggtaaggaataactgtaagtgcagatgaagcttgtttatgctccaaagataaagtcacaaatggggggtagggtgggctgtggccttcccttgctctaggcaaattccctcagcactagagaaggtgccttccaaagggcctgtgttgtgtctgcagttctgttcccagggaagtggaagctgaggcacctgtggtaaagcccctcatgggagcgggggtcagggagatgtttggaaaggctgtggctgataatgagacgcgggtaaccctggtggatatcgttccatcctggtgcgtgccttcctggttgcctcctgctgcctgctcctggggagtggagtgggggaagcattagtctggattgttgttggcttggttgccttccagaggcctgcatccaggtgccagggaaattctgactgaagtccattcaacaatagcaatagcggctcacactcaggcctgctggccccaccattgacagctttgcatgagcttctttccatgcaagagggctgtccccaggttcactccccacttcttgttctgctgcctgcattcttggccacgtagttaagtctccctccctttgtgccccctttatgtctctggtcttctccaacattagccatgccattggcagggtgggggtgggtggtggggcacgcttcctgactcggatgccttgaccccacagggactgagttttggacaaggtgcagcggcagcctcccaagccaggggtgggcagcgtctgctgagcagatcctggtcctctcggggtggctgcatcaatcacacccaaaggggagaggcctcagtatggaaagtatgtgagccttggatggaatcacggatggcccgaaatggcttggccccttgtttctaaggccccggctggtttccccattgtgcagtggggagggagaaaggggccagcttgcctgagttcctggagcacgagtgagagtccctgagccacaggtaggtgagggcaagggtggcagtgttttggggtgtccacgcagcatgcatggctggtcctagctcggatgttgtctgacagtcacccatgaggaacaggagtccctcccattactcagccaagggcacagagtgattatgcccggggtgtagcaaatgctctgcaaatagtagctgctctgaccatgtgatttgactggcattgcccagatgctgagtggtggtgccaggattggacctgtatccatctcatgcctccacccaggccctccacccggcagcctggccgccttctcctggtcctggtccccttgcccccaggaattgaggcgtgcatggtgcatttccatctcccaaatcatggtcctgtctgtgccctcatctgctcctcttccacaggcctctcagggaggcaggcagggcagagtcagcagccccattttagagaccaggaaactaaggcccagggattcctcagaggtcaccaagcttgtaaatggcagcactgagcctcaagccttgctctttggatcatccactttgtattagtctgctcaggctgctatgacaaaataccacagagtgggcggcttagacaacaggtatttctttcctcacagttctgggggccacagttcaagatccaggtgcctcagggctggcttctgcccttgctggtttgtagatccactgtcttcctgttatgtccttgcccggcctttcctctgagctctctggtgtctcttcctctcctcctaaggacaccagccctatcagttagggccccaccctgaagaattcatttaaccttaattacctccccaaagccccacccccaaatatagtcacattgggggttagggcttcaacatatgaatttggggacaacacagttcagttcataacacaccctgagccccctccactgtttggagtcccctaggtcacaccaggggggttgctggtgctgtgcatcagaggagccatttggagagactgtgccagaggccaggggtggggctggggcaatccaggaaggcttcctggaggagatgtgtgtacacacgagagggcttgggggcagtacatgcccttacgggggcctatttcagggaaccccacatgtaatccacaccagtaactcagatgagctgtagctgttttccaggagccactttctctccatggttatggcaagaggggagcctccgggtcctgcgtggcccagcaaggcagctgtgggttgatgcagcaaagcaggttgtgtttccaggtcattcgtgtggaagggaatgggatcccaggtgggcagggccaggcaacaaaggccagaaatcgagctgagcacccacgaagccttcctcagagcaaagacctgcagaggggaccactgcatgtggcagctgccccagatgctgtggccctggctgctgtgggagggtaatttttgttaagatgaactaagttgggactgcatctcacacagtggcctttgtataaattcgcttgccttcctcatccggtatctgtcccctctttggttcacaccctggatgcaggtgttcgggggaatgtgcattgccacacttagaacattcaagtttctgccatccctgtgtttctggagtgacagtgatgttcccgggggggaggtgtgggttcatgcagcaagtcccatgcagagtccggggcaaattcaggtcctgagtgaggtcgtagtgggtacctggctagcaggctgaagggaggttgaggagattgaggaggctgagggggcttgaggaggctggggaggctgaggaggcggagggaggctgaggaggctgaggaggtggagggaagctgagggaggtagagggaggtggagggagactgagggaggtggagggaggttgaggagatagggggaggctgaggaggccgagggaatctgagggaggcagggagggaggctgaagagtctgagggggtgaaggaagttgagggaggctgaggctgaaggaggctgaaggactctgctctttgggtagaacttcctgtttctcatgtttcctctctgtagaccacagtgcccagccctgccccaaagcagagccagagcttgtgtccatttcttgggtgtgtagtgtgcctttggcttctctttagttgtgccttggaatggcacacggggctgggtgggattctggaggcgcttagtgggtggcttctcagagctcaggccacagcccttgtgagtgggaagagtctgtgtgagtgggaggagcctgtgtgagtgggaggagtctgtgtgagtgggaggagcctgtgcgagagggaggagccttgtgagtgggaggagcctgtgtgagtgggaagagcctgtgtgagtggaaggagcctgtgtgagtgggaaaagtctgtatgagtgggaggagcctgtgtgagaggcaggagcctgtgtgagtgggaagagacttgtgagtgggaggagactgtgtgagtgggaggagcccctctcgcagctccatggtcaagtgtttgaggctaagttaggagaagatggtctgtccgtcctcttcctccctcctccctcctcctcttccacacccggcccggggccctttgctctgggtcatgctctgttcccaggccctgtggggatgctgggaaccctgggaacacagctcccttcctgcccgaggccctgagcgttctgagcctgtggccgctgcttctctggtgggaaacggtggtttcctcttgagggaagtgttagtcgctgcctttccctccctctgattcccaaggatgagtctctttgggacagcaggtgcctctgggaaggtctcctggctaggtgggctctggctccctgggagtactgtgggctttggagccaaaaagacctggacgcagatcccagctcctccgctgatgcactgtgaccttgggcaatgcacagaccttaaactggctgtgccctggttttctgtccagcaggaccgggcagtgctgtccactctacagtggaatgaaggcagagaatggcgcatcagaggtgcggctcatggcaggtgctaaacacttgggagtgtctgggcgcctggtgcgggaacatgagcagaagccccaccccacttggatgtctggtggtcttcgctgctttctgactgcctagatggggaggcctcgaggccatcatgattcaaccattctcttactcagcaagccctgaccaccattcattcattcatccattcacttccgagaacctgccgcgtagtaggccttgttctctgcactggggcacacaaccatggataagacagaccaggacttgtgctccaattctatgttgaaggtgagggaagaagttaattaagcaatcagccaagcggatttcaaaggacagctgtgctgcacgccactgaggagacgtgagaggaatcctggctaggggcctatgctgggtgcccggcagtgggggaggcgcagagggggttcagaattgaaaggctgggtgcggtggttcatgcctgtaatcccaggactttgggaggctgaggcgggcagatcacttgaggtcaggagttcgagaccagcctggccaacatggcgaaaccctgtctttactaaaaatacaaaaattagccaggcgtagtggcgtgcacctgtaattacagctgctcgggaggctgaggcaggagaattgcctgaacctgggaggtggaggttgcagtgagccgaggtcgcaccactgcactccagcctgggtgacagagcgagactctatctcaaaaaaaaaaaaaaaaaaaaaaaaaaaaaagaattgaaaggcagccttgaccttaggaagtgtgctcaccagctgcaagctgtcccacctccatactcagtgattattggaggtgatgctactacaagaaggaataatattttaaagaataaagtcagttcttaggaagccggtagtaaccctgtaacaatctggtgtttaatcatttagataaagccatagcctggggtcaaagattggctggaggtgtgcctggagcattaagctcatgctcaccaccaaacttcctgtcccttgtaagtaagtcagtgtcatcccaggtgctggcatggccagtttaggatcaccctttgcctgtgcctttggggaaccccaggacacttgagtctgaatggcctgatgtggctaggacaagggcagtcttgcgcaactcttccatcttgggaaaacaaatgtgattcctaatgtgttgcctcgagttcctggaaccagggtgtttgttttatgtaatagacagcagagaccattctgttgacttcagagccttcctgcatctaaactataactcttcataaaatgtcctttcaatgtggtttatccaggatatcgcagggaaggaagactaaatagtgtctcacagggaagaagaacattctgcatttcaggtcaccaccttgagatacgaacacgtgcttttgagatttggggaccttaattcctctgggaaactcctctctttgctgagtgctggggctgcccaagaagcatgggacccttggagccttattatagccccatgggtcagactgaagatcaggtgggtacattgtgtttgaagcaacatctgtatctcccaagccacggcaaaggagcatctgaaactcatccagatttagtagatgagactaagctggtgaacactcagttccatttaaccccttattggcagcctatgctcacactctttcctggttggcaagtgaagaaggtgggtataggggattttggcaaggatgttagtggatagagtattttttgactgggcatggtggctcatgcctgtaatcccagcactttgggaggctgaggcgggtggatcacctgaagtcaggagttcaagaccagcctggccaacatggtgaaaccctgtctctactaaaaatacaaaaaattatctgggagtggtggcagacgcctgtaatcccagctactcgggaggctgaggcaggagaatcgcttgaacccaggaagcagaggttgcggtgagccaagattgcatcactgcactccagcctcggcgacaagagtgaaactgtctcaaaaaaaaaaaaaaacaacaaacagtagtttctgaggacgaaccttgcaccaggagctgtgctaagtgccttgattgatctgtaccttctagataggtcatactattattatttctattctaggaccagggaagtaaatctgagaaaaggtcatgcagctagtacgtggttgtagaaggcagagtataggttcagctgctgtagcaaagacctagactaacattggcctaaacaaggtggaagccggtttgtccctcatggaacagtgctggggttggggtctactagggctgctatggaaactctgtctgcatggtcacccagttcccagtctttttctggccttacaatgttgccctcgttgacatgggccaagatggtgcccactgtgtttacattctagcctctgggaagagggaagctgggaggggaagaaggggcacaccttttctctttaagggtgttactcagaactaacttggatctgttgtttctgttcacattccattggtcaaaatttggtcacctagccacccctagctgcagaggtggcagggaagtctttcttttggagctaaaaatgggagatctattactatagaaaacatgatgaacagctattgggtgacagctagtgtttctgtcccagaggtggagctgggatatgcgtccaggaggactatgcatgggttcacgcctctccctcttcactacctcctcctggaggacatctaggtcagcatcaaggaagaagagtccggagctagaccaagatccttgggcaggggtggcgggtatttctgctgatcctcggattctctgggcctagcacagtgtagggcgcaaagcagggttcagtaaatccatcttaaagaaagggagggagagggagccagccttgcagatccaaccccagcccaatgagctgagcaaacctggatgtgaatctaagggggctgggaactgagacaccaatagccagaaggcagctgggtctggaggggttcccttgggggtggagctctgcaactgctttgggctggaccagaggttcagggtatccttttggctcccagggcttaaccccaagattgaaggacatctgtgagctttgcttccagaatggaaattttttaagaagccacctttgggaggaactgaatctctgtcctggtggtggttgcttgggccatgccatatactttctgaatttggttgcagctgcttgtaggtccgtgtttgtcagctgctgcccccaagtaaggctgtctgcaaggaagggtctctgcctccctcctgctgtaccccagctgcccactttagctggccctgacttatctagtacaaaatgcagttacggtctgacctttcagaaccccgggcccccatgaaggcatccttgaagggctttcaaaggcagcatactgcatatgaggagtttaaagtttgcctgtctctgtgactgtattttctgagcaaagcttttctccatgcaggtgcgcagaaggaaaaataagtaagcataagaggttccagtttggaatttttcaatcatctgaatgttgttcttggcaaggagtaatttaaaacagctgttatgggttacatttttagaccagttagaaataagggtttcaccacaatcatattctttgatcatcctaattatttttttttctttttcccagttatctctcttgtgctgagtaactgaggagctacctatcaggtttagcgtcagttacagacctgtttcaagcctggcagttggagggaagagaaaagcattaacacggagcagcagcgccccaggctgagacagagcttacaaggtctagacagttatgaaatatgtgggactctttaaaaagaaagaaagaaggagagaaacgcacatgttttaggttctccatgcttgtattctgtatttgtatagctgagaaagctttagtttaaaataagtggtatttggcaagcagtggtattgcatgctgacaaattgattgtgctcttttacttagataaaaatgaaaatgcatgaggcatgttgcttttttccccctcttgatgattaaaaaacgtctacttggctctctgcagagacagcccttgaagatttatatgaaacacctgtgtggcatcgatcacaggccttcaggctgacagaagcagctatgcttcatggcggttaaaatgccaggtcctgggagggggtttggaaagacctgaataagggtctgtatgccaggcttgggtgggacccttcggtgagggtctttgaattttaataaaggacctccccacgctgttcataatgatgtagggcttagagcagctaggcaggaggctaagcatgccctggggtgatgaacaagacaaaagccttcccctacccggcctcagtttccccaccaggaagatgaggccatcagactagctttcctttcggttttctacaagctctatgactatgttcccctcaacacaccctttcttaggctctggcgttattgggccataaaggatgaggatgtcagtgcagacaaggcactccgcttcctgtgtagcagttcacagcctgggccagcacagggagaaatttggaaacaagtatgttatgatgcagccatcagctgcagttgatgtgttgggtcatgaattcattcattcattcactggtcaaacgttattgcaccccggctctgtgccaggttctatgctgggtgccaacatgtgcagggaactaagcgacctggtccctgactgctccaagtcgggtccaccccatttgggcttctgtcctgttggcttaaggacttgccctggtgtaggtctcagcacaggaatgtgctgtgaaatgcaattccaacaccctattaaagccaagcatttacttctggaccccggggactttaagacacacccttaaggagcaacggatttgttttgacaaaaggagtgtaaacaggatcctggtgaatagctttctcatggctgctcctgctttcatcaattgcatatttattggtgacctcataagtgtccagactgtcctgggctctacaggggaggcaaagggggtggcggaggagagagagaatttacagcttagttggggaggcaaggccagctctcaggatagccagcgaaggtgtgagacagcacatcagttacatgatcacacatgtggtgcagctcacagaactgaaggaactcagggcaggaggggggcagctactcggctcagcttttctttttgggaagagcaacggaagaaagggcattccagatcattctcctggcccagccactagatgttgaggcccagttgatagccagccccaaagctgccacagctttcccatgtctttctatcctggaggctggagcacccctggacctgaggaaattgattgaccaataggtcattggtacatctaggtgacaggggtgcctcctccccaccgtggacccctagaggttgccagatggtgccactgatgtgatgtcatccacctctcagggtcccgagtctttgtctgctgctgccatggatcccttaaaagttaaaagatgcagaataattgttctgctgtcagcaagagctgagttcacatcccagctctgcctcttgctagcctgtgaccttgtgccatttccttctcagtgtctcgattttaggcatctaaaatgtgggctgatgatagcacctgttctggaaggctgttgtgaggattgcatgagacatgcatgtagtgtgcctagcattgtgcctggtacgcaggaagcacctcattcatgtcagttgctattgtttccattattgttattataatacatcaggtggcaaagtggaaaggccagtgtctgaaccaaagctcatgtctttctgaaaaccagctctaccaaactctaaagatccgtgtcgaaaatcccgacaccacgagctagaattctgctaagctctagccttccctgtgttagattctgctgaagcaatgtgcctctcccccatctctcatctggagtgtgggcattggtgagctcgtgtgcctgtgaaacacccatctcttcctccttcaggacacgaagcctagcccttcttgagtctggggccaagctgagcaaagatggaaggaggcttggcaagagttgatgtcatttgacatttaatcaccaaagacccagattgggtcccagcgagttaaacccactgcgccctgttcttgggcagacagggttggggtgtggtcacatggttggctgggagaatcggagctgtatctaagactctaagagcacagaataattgctttcaaacatttgtcctctacatcccaagaatgacagccaaagggcagtataacagaaagacaggcttggtctcaaaatgggaatggcctcacagcatggtgttgataaagagtattggatgctctgcaggtgaagtgcttcctgtccctgtgagtgcacacgccagggctggctgagcccttgatggggatcatgttgggaggattaagggtggctgggggtcttgggaccctgagacatcaggactttcaggagaccatcagttgcctccaccttccgaggcattcatttctccagctgcttttggccagcacagccgtgatcctcgctagaccccggccagtggcccaggaagaagccaggcgcctcggcagggccagggcaggaagagccaggtctgcctggaagctgctatttgccttggtccctggcttgcccagccgtttcctggcccggccctccgtggcttttgcttgattagctcatagctccaggggaagccagaccccgggccctggaaggcaagatgggcccccagtcctccctggcaggccagggcagcgtgcaggaaggatgggctgggcattgccatgtgaagtcaacctgaaatgcacttgggagagactgaggcactgagcggaagtaaagactcccagatttcctgaaatgaaagccagggctccttggcgcccctcagagccccaggcctctgcgaaatgctgcctttaaactcatgcttgtgttgctccagccgtattgccacgtcgcaggtgcggggtggtgctgggggcgggggatggcagctgggtgggtttaaagatccccagcagtggtgaaccctccttggggctctgacgctggagaaaggccccatgccctgtgatgtctccattcccaccaggctcacagccccactgtgaagctaccgaaatgggaggcatttaagccccccttgttcatcagccctattttgtaaaaggggaaaccaaggtccagagagaagaatgatgggtcagaggtcatgcagggtcagacgtggagctggacacaaagcccaatctcctagccccagtcccatgcaccgatgtgctttctcgaaaggggcatgccaggcagggcccctgggctcagaccgcctcacttctgggggctctgggcttactgtgctgcagctctgagcagcaggcagcctggcccagccttgcctccgcccagggacctgagcccagggagccatgctgaccctttcgttgccttggacagaagccaccttaggcacagccctcatcatctacttggttcagggaggccttcacttctggcagagcatcaggagaacgtgggctggagatatatactccccagtttggaagcgtgtggcctccctgtcacagtgatctgtttgttggtttgttcaatcattcattcattttagataaacacctgtgctcctgcctgggccgggcactgatccaggtggtggggataaaatggtgaactggaccttacagttaatgcagtgttggaatcacctagggagctttttaagaaaatactgacgccctggagatttgatgcagtcggtctgggtgtggcctaggagtttcactttctaaaactgcatgtatctggatgaaatttctttacaaggagaaaaaaggttgtagaaagaatgtccttctaagtggatggtgtcccaggtgcttttaggcggagcacaggtgaggaaaggccctgggtgttcaagacacaaacagtggtcatcactgaccaaggctgtcccaggtgccccgtcccggctcactggaaggtcccgccacaggccacgcagggtaaaacaaacccgaagttcttctgagcagctgcgcattccccaggccccgcacggaaaggagagctgtctggcagtcacagttctttgctttccaggctcttcctgatctcagtgattttgcagctgtgcttttaggagagctgttttcccctcatttgtaaaaactcaaaaatatggaaaaatagaaacaaccacaggtcacgcatgggtgtgtttcctttttgccccggctcttaaagcaccagcactgctgatgcgccaggtgccttttctgcggacgcctctttggtgtccccaggctagcacaaaagtggaggttgcagtcagcctgccgggcttccgggcagaggagagggctcagagcacagtgctttggaccttctttccgatatgccaggccccttccagcgactgcctgtccagcatcaggatctacctgccaagtggtcctgccgttccctcagtccacccccacccctgaccctccgtttacccagccagttctttgcccattcccactgcaaggagatatctaaattgtttgccttttttgtccttggtgatagaggtcactgccggactctggcagctccattactgctcatggtgatggtatagtccatgtcctgtccatctcagcccccagcccttccccagactcctggatacctccctgactgcatctgatgggttcaagccagagacctggaccctcatcagagaggcaggggcccgcacaagcacccttccacccacccttttcttccttccacagacccacagcctagagccttctttcctccccactgtccccgccacacttcccctgcctggcagcccaggcccagacaccctgcgattcagtggtttcacatgtggcttctccaagtgccaccaaactttgtgagacttgggcttaataatttcgatcccacagaaacatgtgacaagcacaagacattccgtaaaactagagcccagaacgagagggacgaatggcacaggaagatggcagggcttggtttgggtgtgtttgtgtgacacaccatatgtcattttttattcacacaaaaacatctttcttgaagtaatagaaggccactcagctgttgctaaccacataccaaatgtttcctttttcctctcctgcgccttccaaggggcgggctgggaagctctgctgttatccgtgatgccatctcgcctttcaaacgtcagagagctttttcctcggagcaaacgcccgattgttttttccagctttggcaggaatttttaagagaaagctgttttcgaatcacttctctgtttattgtttcaaacctgaaatacggcagagtagagggctggcagcctctgtctgatcctctctccccatgtccatttcctaaattgcattaggatctatcagggacccccttctctgccacagccccccgtaacctggtattttgggaaaatgaagttaaataaaataaaataaaccttcagttggtggagagatggttccaggcatccctttggacacccccctccttccacccccccgccccactccagcctcacaacctttacaatcaacatgtggtttcatttccaagagccccagtgttagcatttccatttcctcaggaagccgcgttccgtccttgctcttacttctgaaattgaacgtgtgttttccttggcccgagctctaggagtgcctggggcaacaatgcacacagtcccaagcaggtttcagtggggtggacagccctccccgcacccgggctgcagcttctccccgctccccgtccccagggatggccgcccactctcccctagcccggtgggagggcctggctgtgctcgggccccgtggccatccgagggaagctgggccgccctcactgcctgtgtcctcgccacctcctattgggaaactctggttgccctccaagagtccacatactgcaggctcttaattaagaaagtatgttcccatttcatgtcactcgaaaagaatgaaaacagtgacagcatttatttatcttaactatcaatatcattcctgtttctcagtccgctgggggtatgagtcttgaaggaattgactgggttatgagatttgaacctcgggcatgtgctggtgggacacatgtggcctgcttccgagaaggagccttgaaggaagagcaagcaggctggcatggccctgccctgccctgccctcccggagctcagggccgaagggctcggtgacagtggggaactcctgcctgctttggtgctaatggagagtcaaggttcctttttcaccagctacctcctatctcctttctcagtcatcggagaagtaaaacccatcatttcctgagtctgatagaggagataggatctgtccagtggctgctgtttctgtggcacctactgtgtgctgaggctgggccaggtgctcacatgcgttgttgccaatccccggcagcaaccagctaactctgatggcctcaggtaaagggacttgcccaagaccacacagccatccagagttgctccactgtggagacactattgccatttggagcagaataattatgtgtggcagggagctgtcctgtgcattgtggggtatttagcacatccctggcctccacccactaatcagtagtaacctcacagttgtgataacacaaaatgtctacagacattgccaaaatttcccgctgctgaaaacctctgagctaggggatggaggtaggattcagacccaagcctgtgcttgttcgccaccctgtgctagctctgaagaagtcctcacccaagcaaggcaaccctgcttgcctttaggatccaggcagcgtggtagtgctttggtgtttctgaactatgtactaatcagctatagatataggcattctagaatattcatgaggatccaacttcgtggtggaggctgaggacagaagttctttaatagtactgccccatcttgctgtggtgtcctgacagtgtagcactttactgcaaagcctttgcatataggttttcattttgagtcttccagatactcattatatctgaaggcttattactcagcaccaataaattgcaagggactgaaacccaactcaaactaacttaagggttagaggaagtctgttggtttatgtgactgaaaagtccaggggtaaatctcatagcttcaggtatggctggatccaggtctcaaacatcatcaggacactatttattattctactttctacagttttgatttcattctctgacaggttctttctatatggccacaagatagccaccagcaactccaggcttacatggtcctaagagttaaaggcttcaaataaagaaaaagtaactttccttagagtgccaaaaaatgttcaagtaaagactcagattggtaaggcctgggccctgtgctcatctccgagcttggtgttggcctcacccaaagaattattataggggaagggatgactctccaaagaaaggaatacaagaccttgtgtttctagagcagttcaaagtgtggttcgtggactgattttactggtctgtgataagtacagagatgcttagaaacactcatagcaattcgttgtggctgtagcatccaggtgtgtgatcagtggactcatcttgtggaacaggtgataaagcagttggctgttgtcagactcacgtggaaagttgggaacaatggagatttacaaaagtatcagtccgtgatggattggaaatttaaaaaactggttcttttccatagatagctggaaaagcactgctttaaactggagagtatgttaaaacacagatttctgggccctaccagtggaattctgattcagtcagtaggtgatatggtttggctatgtccccacctaaatctcatgttgaattgtagctcccataattcccacatgtgtgggagggacctgttgggaggtaattgaatcatggggatgggtctttcccatgctgttctcatgatagtgaataagtctcacaagatctaatggttttataaaggggagttcccttgcaaacgctctgtcttgcctgccaccatgtaagacgtcccttgctcttctgtcatgattgtgaggcctccccagtcacgtggaactgtgagtcaagtgaacctctttcctttataaattacccagtcaggtatgtctttattagcagcatgagaacagactaatatagtaggtctgaagtggggtggggggaatgagaatctgcattttcagtaggctcccaggtggaatattttgagagttactgaaatgtgacacagacaggaagttcgcacatgctgttggggaaatgaaaatggtgcggatagacttgctcgacacggggttgccacaaaccttcaattcatataaaaaatgcaatatctgcaaaagacaataaagtgaagtgcaataatacgagtgtgcctgcgtagtctgcggaggctttcactacaacagcgagctgaatcgttgtgaaagagaccatatggccctcaaactactaccatatggctagtagtaaatatctcccactagccctttacagaaaagtttgcctacccttgccttagaaccagggggtgagatgcgagatcaggaatccctattgaggttggatggaaacagtttttggaatcctggttgaaactgacctccaaggttgatcttggaatctggtctaagtccctgtaatcatctgcatttgtgaagctggcatgccaagaaggtttgcaggttgagaaggggcttagaggttattattcgaacccccttattttatggatgaggaaactgagaccaagaaaggggaagtgacttgtccaaggttacacagagaattgatggcagagctgagaccgacccctgcccagtgctcatccactgtggtgtccttggcaacaggcctggggtgtggtatctttagtggcttacaatgagaataggctaagaggcaagcgaggtctctcccaagcacccaaacctcaccaggtgaaggtggtgaggacaggggccccttggcttgctgtgccctctgttggttgacgtaccctctgttggctgacaacttggcaagtgtgagccctgtcctgggaagggcagagttggaagtgagttggctgtgcccaggcccccaagacgtgtgttgcttattgtatgtgcatgtgtcttagcatgtggattttcagccagttacattcattaccaaggaagtgtacttgctggtacagtttggatatttgtccctgcctaagtctcatgttgagatgtaatccctaatgttgaggtggagcctggtgggaggtgtttgggtcatgagggcattgttggtgatagtgagttcttgtgagatctggttgttgcagtgtggcacctccccttcaactctcctctggccatgtgacatgcctgctcctgcttcaccttctaccacgattgtaagcttcctgaggcctcccctgaagcagatgccagtgctatgcttcctgtacagcctgtagaaccatgagccaattaaacgtgttttctaataaattaaccaggctcaggtatttatagcaatgcaagaatggcctaatacacttgctggccactcacttaacactacttgctggttctcgccccttcacgcctcacctcccatccctgagtgacctaccactttctgtctgttttctttaggacagtcttgaagatccactcagtgacatcctatggtggtctcagacctagcccagaattcttgtcctaattcaccttctcccacacttcagcacaccctgcaggtcctcctggcatctcacctggaggtttcacctccccactgtagcttctccttgcccctcctcccagcctcaagccccattctctctggctttgacctttttccctcttcttcacctggactcagcttctccccctgcctgcattgtctgctcattcccatattctagtgtgctctccatggccaccacccctgaaactgacccagcatcatgagaggatgtcttgccccctctgccacgacaccttccaggacacttcccaattgacttatgcagttttgttacatagacattgttatgtggcttctctttccagtgttatccatgaatgtgcctccctctcacactggccagtgagcaaactgctaaggacaaggactaagcaagtgtctggtaccttgctaaagggactgcctgctgggtagacatggttctgtctgagcgcaaggctggaattcagtgtgttgcaggaaggtgtggcaatcccgccttcccaggccagctgtgggcatgccggggaggtggggagtgtcaatcccttgaagaaacaaacaacacatgtcgttttcttgaagccagttcagtccagctgctcaccaaagcaggatcccagccgcaggagctggtagcctccctgcccaaaagctggggcctgagcccacaggccacaatagctcccaaaccaatgacttcctctgtaaatgtctcagacttgccgccaccccatttttgtccccttttctgtggactgcacgtgaatcatttttgctctaaattattgatttaccagtgagacactgaatccattccagactcctggcctgagagtccagccctttcctgtgtgagtccagcttgccttcccagtgtatctcccagcaccctcctgtgtgcataagtaggcctagcccctcccagggtgctctgctccttagtcaagggcacagctcagtgccctgcagcttatgatgggctttctagacccttcccctttcccagtcaccttcctcttccaaatgtcacatcacagagatgatgtcctccattcttggccagctgttaattccaagcctgttgctggatcagtaaccggccagtgggtataagatgtgtcccttcccactgacccacccacatatccccacgtgttgagttcaagaagatacccttaacatcaaaggaaacttctagtatcaaaaagcaggagacctcagaagagagtttgttgagtgaatgaaggacccaaaatagcaaagttagaatggctggatgatttgtggatacttaggggccgaggagctccccataccctactccctaatgccttttttttttttttttttttgagacacagtttcactcttgttgcccaggctggagtacaatggcacgatcttggctcactgcaacctccacctcccaggttcaagccattcttctgcctcagcctcccaagtagctgggattacaggtgcctgccaccacgcctggctaattattttgtatttttagtagagacagggtttcactatgttagccaggctggtcttgaactcctgacctcaggtgatccacccgcctcggcctctcaaagtgatgggattacaggcgtaagccaccgtgcctggccactactcccaaatgtcttacataaagcagcctctttctggcttggaggaaaagatcaatgaggcacatggaaagcaggagttccatgttctagaagagcaagtgcgcatgcgcgtgcgtgtgtgtatgtgcgtgcgtgtgtgtggacagtgtgtgtgtgcctgtgtgtacagcatcccagtgttctcccacccctaaagatagatttggagacagagagaaaagtcttctgcccttgtcctaggtgtttctcctcaccaaccccaacagaccacactttggagaaagattgtgggcaggcccccttccaagctggatttcaacaacattgccagcttctgttgaaacagatccgaaagggtccactccaagcatgtatcgtagaacttctcatgcttccaacttcaatgtcattgactttccagaagcaacctatacctcgggtttgctcttgatacatcaagaactttgatttgcgcctcctcctgtcaccttgatcattcccaaattcgtattcttccttctgtggcctccttatccatttctataggaactgtaaatgttgcactagggatgattttgtttttgtgtgtgtgcttgctcagaaaatgaacccattgatcttgatttgaggtgaagaaagaaatctaaaaagatcattactggtccttttatttctctctaggcttccaacgagtagtttttttgcctgggatcctctctacagctgggagaggctcggaactgaggtgctgacagcttgtgttggaatcgcatggtgtttactgtgctgggagtttataacggccttgtttccatactgacagcaaatgccatatggagagaaaaaaaaatctgtcaaatgaacccttaagggatcacaatatggcacatgaaatctcaaaactgcttttggaaaaggtgggggtagaggggtaccttgcttaaatcacataagcagcatggtgctctctcccataattgaataaaaatggaatttgacacaaggtaatttactttggttctgtgtttgtgctgggaaaaactgattgggaaaggatgcaaagatttgttttcctccccttgggggattgtgttgagtgggaggcaacgggaatgcaggctgtatctgcagggcattgtgctaacaggtgcaggctgcagacctgtcacaggccgctgagaccaggttccctactgtggctgatgatcacactcatctagcttgacattttattactgtcatttgagatcttgtctgttcacccacacacactcctgctgacctctccaatctgagtccaagctccctgcgggctgggaccacatccctaggtacccctccccgtcagaacctggcacacactgaggctaaatgcttgttggagtggctatttgtgaaccatctgtgctgggagcggtggagactgcgcccacggctgaagggcagagtttaggctgcagtccagggctagttggagccacaaaaccatttgagagtgggccaagaggggacttggcaggttgctcatccatgctgatccaaatactcactcgggagagaatgaaacgttttagagtgccttcttcaacatacgctacttagaccgggcgaattcctcccaaaaaaaccttgccctcaggtaggttacccatgaaagaagggggcctggccgcggctctttccgttccaggaggcagacagcggagtgctgaggccgtgtccccgtgtggtgaataaatgcccgggagggcgggctgccttcagggctcctctctccgctcatctccgcttgtgtgcgggctgcgcctccgtgggctctcgctgcgtggggggaaggcggtctcagcagccctcggctgaccagtcatccccaagaaccctgctggcatcccagggaacagacagtgtctttcctggaagttctggcaaaagccctgggaggactccggggcccccacggatcacaggccctgacctgattggctagaactgaggcatggccacccttgaacctgtcattatggccagagagagaggcctctgattggctgtgactaagtgacgtgtccatccgtgaccgtagcactgtggccaggagacagaggccttttgattggctgtgactgagtcacgtgcctgtctccgtagcatgggaggcgtcagctccccttttagattcagaggcttgggttgaattggtgcagactgggagaaaggaggttccctaaaggaaagggagatggaacagaccaaattatcacatccataacgatgagaaatggggtttattaatgtgccagcatctggtctgagtggtttctatgtattgtcttattcattcttcgggacggtcctaggagttaggtctgcttaccgtccgcagtttacagactagacaactgaggggcagtgtcaagcctgttgccccaggttacacaggcagtgagcgatgggctgggattcaaaccaaggcagtttagctccagagcccacactgacactcacagctaccacgagatcctccctcccggcaagccatagctttacatcctgtggataagcattttgagactaagaatcaaagtgtgccagcgcagtggttgtgttcatatccccttgttgcctggcgtatctcaagagaaatcctttctaggggggatggtgtcttagctcctctacaccaggtagactatagtcatcccttccctgcaagttgctgtccttcccaggctctatcgccctcttccctgtttcccacgaactcatccgactgtgtcccgtgcagctgcaacatcgatggcctagtgttccgtgctccagagagcctgagacagcatgtttcagtggttccttcgagtatcttcctggccagagagaacttcttggagaggctttagcatcactgcaggaagaaccaaaagggaaagggcccccatcccaactccagcatgcccttcttgttttcagaggagaacacagaggcccagagagggcaagtgaattgcttgaagtaacacagcaaattgttggctaacaccatggtctctgggcctcttggtgggagtcttgcagtatttcctcttcagaaccctcttggctattgagtgggtaagcgcgggtgacttcctgtctctgtgcctttagtgcctaactggaaaagtcagggttttcataatttgaagcatcctaagactgggcttttctccagttgggcaaaaatgatttttaaaaactgtatccattaggatgctttgaattagaagtaatttctaaaagtgttcaaactgccctaaacaaggagaatgtgttgtctcataaatcagcttttcagatatggtttgagctacaggcatggtttgatccagagattcatgacatcaccagggcaccaactctacttcttctaatttcccagctctcacctccttgatgtgtcaggctcatcctcatcgcggcttttcttgcagtgtcaagaacactgctgcagcacctggcttcacacccactcaccatgacctccagaggaagagagcacctctgctccagtgttcccagggagtctgcagtccactctgattcgactggcttacattacaggcctgccacccttatccagtcactgtaatcagagaatgtgatgtgcttaatggccaccaaggagatggaatcacagtccccagaactgctggcatgtccatacagaaatcagagcattggactgggggtgtggggtggggagtagaggctgggtcatcactggtgccttcttctacactgacgtctctctgagtctgtgaagaccatgaaatgaagaaggcgttctgagagtttgccagtcaccttcctccatccatctagggctctgagcccaggtgtgggaatgacaggaaggccctgcctggccttctcctgggtctcatcacattcttcttttcttgtctccagacagagattactgcagtttatgtgacaagcagccaatcgggaggctgcttttccggcagttttgtgaaaccaggcctgggctggagtgttacattcagttcctggactccgtggtaagttcctgctcctgagggatggtcctgtggtcctctgtgatcagtgattgttttggctcaaaggaaaaaatagatctcatgggttagaagactgaggaataaactcactgcttacaaaactcccactacagactttgattaggaatgcaaaattgtctgaggatctaaacacatgggtgaccttgggtgaccttgggtgggccccctcccctctggaccttagttgctattgctataaagtggagccctatcagctctttgattctggaagcctgggttattatgggaggcagtgcctggggaagttaggcctagctcttggatctcaaggccccttcctccagctgagaacccattttatagaattccaaagcttttgtctgtttgtacaattgtttattgtctgcttccccattagaatgcaagctccctgagggcaggaccctgggcttcctgttcatacctgcctcacacagtgcccagaatctatgggcactcaatacatgtcaaatgaagcacatggctgtcaagccggtctgacaccaatggctccactgggctctggcatggatgacatgcctgacaccatggagtcttccttcacatgtgcttgttattctttgtttaacaaatgctgattgattgcatgggcttttaagacaggttgtgggaatagtcaggagttcctctgcacctgcccggggagcctgggcacctcggttcagccaactgcccttgggtttctatccgaggaaggaggacaagagggaaggaagaggagtggagagcggtcatgaagggtgtgaagtcatccaggcccctcccctccccgccaggtgcaggggccgagaggctgctgtttcctgaagggccctcatgccaccattggctgcagccatcccgacctctatctcagtttgggggacaaccctttagggtttcaagtctctgtatctgcttcaagatctcgatgtgcatctctagacccacaaaccaaattgcccactggacatctccactgaagtcacaaaggcccccttaaagtcagtaagtcccaaatgcactcaggactttctcccaggaccccaaagctaccagccctgagacattacctgttccagtgaccagcaccctatagtcacccgagcctgaaatctttgcactctttgatgccttcccctcctcgtccttccccaacctgatcaggctcatgtgcttggctccttgaccctgcccaggccagctccctcccctctgcaggctctgccttgggcttaggggaggctctgccttgggcttaggggaggctctgccttgggcttcgggcaggctcttggcgcctcttgtgtgagtgattacagtagttttcaatcttagctgggcgttagaaacacctggggagccttaaaaacacaccagagcctgagctgaagcccagaccaattaatttgaatctctggaggtggggcctagtattttaataactttttattatggaaaatttcaagctataaaaagtaaaagtcgacagaatagtgtaatgaacccccaggcacccttcaccccacctttatgaacccacaattatgaactcatggccaatcttctttcatccattcctccatcctttactctgtaacactttgtagcaattttcacatattatctcatctgtgaacttttcattatgtatctctgaataagagctctttaaaaaatagtactatcacagcttaaaaaattctttcctatcatcaaatgttagtattcagatttccagtgttctcatacattttatgtgtatttgtttgaactggtctggctaaggtccacacgttgtgatctgttgatgttttcttgactctaggctcccccataaccatccatccccctttgtaatacatttgttgttcctacagaagagcttcccacagtctgaattttgtattcttatccctaaatgtcatttaacaggctcctctatatttctttcttttttttttgtttttgagatggagtctcgctctgttgcccaggctggagtacagtggtgcgatctcagcagactgcaagctccgcctcccaggttcacaccattctcctgcctcagcctcccgagtagctgggcctacaggcgcccgccactacacccggctaattttttgtatttttagtagagatggggtctcaccgtgttagccaggatggtctcgatctcctgacctcgtgatccacccacctcggcctcccaaagtgctggaaccacaggcgtgagccaccgcgcctggcctggctcctttatatttcttatacgttgctagttggatctagaaacttgaccaaattcggtttccgtttttgcagggtggagtgggattcgacttcctcagtggtttcatgttcttccatcaggggacatacaccatctggttgtctttctttttgaaatggtagcagctattgctagtctgtacctgaatctgttaattaacaagggcttgcaacatggcaacattctaattctgccattccttcttcatttgccaacagaggcacttccttttgatgaccatgtggtgacccagtggtaaagttcatagaggaaatggttgattcttttctcgcattaatgtttctaaaataccaaactggttcactaccatcctccagtagcagtaactatttttaacttgtggttttaaacatgttgcgtgtgtattgttgcactgtagtcattatcctgactgatgctcatcgtctcatcagtggctagtgggggcctctccaggttggcttctgagtccctggctgggctccagcagttatcagtagtctccttgctgtctgatatgacgcagggttctgggctcatcttgtactagatccattgtttctcagaggagctgtgattccttttactgggacatagcagttgcaggccacagtttggcacaagggttattaccactaggccatcgattctagcacctattggcatttttcaaagctcccaggggtttaatgtgtatccagggttgggaagtaatgacatctaggataaagtccaggttccgaggctgacttaccagatcttccagcatcagctcctgcccaccttttcaccgttggccttcccggagtctttcttcagctctgtgttctggcccgaccacccacttctggcgtttctgacttgccaggacagttcaagcctcttggccctagctccctcaggcctccctgcctgaaatcctccccacagtcccatttgcctggcaaatgcctacttgtccttctgtcccctgttctcagaggccctcccgatctccctcttcctctctctcctgctgtgcccctctgctgtgggtgcttgcttctcacatgcacctgagccacactgctgccccgtgctggcagaggtgcatgatgcagagtgcagcctccagagataggatgccaagacaaaatggctctgccaccatctgttggtgagaccatgggcaggtgtttaacccctcgtgtacttcgtgtcttcatctgtaagtggggatatagctgtatctgatgatgggcgaggtgttaggtagagactacatgagttcttaccgctcacaaccatgtctggaatagcactgaggctcagtgaacctagccattgaggggtctgtgtgcctgttcctccactagccagagcctctttgtggcacagacgtggcccatggtctgtgaatcctcagcccacagtgccacacgtaacagttgagtgatgctcagattgggcccagtggaggttggtggcttgcctagagtcaaagagcatgtgaggggcagaggtaggcccagaacccaggtctcctggctcccagtccaggctccttcctctgcatcatgctgcctctgagaccatgagcatcataagccaatgacatggaatgttcgaaggtgagaactgggatggaaaaacaactggagcaggttaaaggaggttgggagtttggatatggggaggctggttgtatcatgaagtaggatggtcagcattggagtctttgaaaaggcgacatttgactgaggaccaggaagtcgttggaggagttagccaagtgaatatgtggtgaaagggtgttacaggcagggaacagccagcacaaaggcctgaaggcacgagtgtccgcagttggaggggagggaggaggggcagagggggtaggagaggaggtgatcatgtaaaactttgtgccatcagagaactttgactttgggtgaaatgggggagccactggagggtttttagcagagcagtggcatggtctgacttggggttttattttattttattttattttatttatgagacagggtctcactctgtcatccaggctggagtgcaggggtgggttcgtagctcattgcagtctcaacctcctggactcaagtgatcttcctaccttggcctcctaagtagctgcaaatacgggtgtgcaccaccatgcccatctgtgacttaggtttttcaagaatccctctggcttccatgttgggagcaggctttgaggggctgaggtgggagcagggagatctgctaggaggctgttgcagcagtccaggtgagagcagctggtggctcaagccatcttagtagcccctggcggtggtgagaagtggttggatttgagacttgtgtggaaggtgtattctctgatggattggggatgagagaagagttaaggaagacttcaaagttttgacctgaacaaatggaaagatggagtaaggatgaggctgcaggagggtcaccttgtggggaaaatcaagagctccgttttaggcacacgcgccttgggatgtccaccagatccttgagtggcgaagctccaggggagatgggtgttcaagccaggcttcatgagaaagatctgggctggaaatggaaaattgggagttgtcaactttttttttttttaatttttatttttgagagtcttactcggtcacccaggctagagtgcagtggtgtgatctcaggtcactgcaacctctgcctcccgagctcaggtgatcctcctgcctcagcctcccaagtagctgggactacaggtacacaccaccacgcccagctaatttttgtattctttgtagagacagagttttgccatgttgccatggctggtctcaaattcctgggctcaagtgatctgcctgctttggcctcccaaagtggtgggattacaggcatgagcctccatgcccagccttggagttgtcaacacatatatagctggtgtttagagagccctgggctggaggagctcaccaaggaaacaaatccacgtggatggagaagcgtgaggacaaaagatgccccggaccaagggctgctccccatttggaaaagaggaggcagcagcagctttgggagccatctagagagttgatgaggcagagcagagtgaggctaagcctaggagtcggtggaattttccagccacgtgttttgttagacacttacagtcagtttgaaaaggggggaaaaaaatccaatggatgcccattttcattctggtcgtgccatcgttccctctctctgggcctgtaccaagagctgttttttggaaaggaaatgtgagtctggctcctgtgtcagcacgtcaaatgctcttcacatctaccctaatgaagctgccactcacgaggggccgacccgctcccttctgcgttttcatctgcatccctgggaattagcgagactttttcatcgcccatcttgacgtcaaatgaccagcctctggaacacctcttttacgcacggagactttattgagttttccagggctggcgtaacttctcgtctaaaatccgttttttcttccatcctgactggaacccagaggagggaggaggtggcggggtccttggtgttgcagtagcgccccgggtgctgcctgactcggccagcgccatccacgccattcccatctctctgttgaatttctaccaagtggagcttttaaaaataacctgtcctcgttggactctgatgtagtccctgggaaaggctcctctcctgcacagtatttttttttttttaatttgagacagagtctcactgtgttgcccaggctggagtgcagtggtgcgatctcagctcactacagcctccgcctcttgggttcaagtgatcctcctgcctcagccttctgagtagcagggattacaggtgcgcaccaccacacccagctaattttgtatttttaatagagatggggtttcgccatgttggctggtctggtcctgaattcctgacctcaagtgatccgcctgcctcagcctctcaaagtgctgggattacagacgtgagccaccgtgcccggccttctgtgcagtcttaatgtccacatttctcaagtcaagtggaaggctgcagctgttttttaatgacggcccaggtgattttctgggcagcagaactgtttgcgcgtcatttactagactgcagggggagtttggcctttggtgttggttatcaagggtcttccaggaacctgagaaagacttttctcctgccactgccacctgtcctctcagcaagaaatggagtcagtgacctaagccatgactaggtctggtctctaaagggcaaagagtttgcccagctggtcaggggattgaagagggtctaggctagtgtcagcccccacagggcaaagagtctgtggcatcttggagactgatggacttctctctaacctgttccctgggagccttgaccacatgctggctcatttgaaaccatcttatctccacacttgggtgagacttaatgggttcaggtctcttctctttgggattgagggatgtttggcagatatggaaccagattcacccagggcacatttatggggtggctcctgtgtgccaggctctgttctagcagttgggagaacacaatgaacaggagaactaagttcctgcccttgtgcagcttgctttctggttaaatgaaagattaaaaaaataaagaagattttttttttctaggaggtggaatctcactctattgcccaggctggagtgcggtggtatgattatagcttaccgtagcctcaaactcttaggcccaaagcgaatcctcccacctcagcctcctgaatagctgggactacaggcgcaggccaccatgcctggctaattaaatttttttttttttagagatggggtctctctgtattgcctaggctggtcttgaacttctggcctcaagtgatgcttccaccttggcttcccaaagtggaatcatgctggattacaggcatgaggcactgtacctggccaaggaaaattttgcagtgaattaagcaacaccagctacaagttaaaatatttgttcagtattagctttgggttttttgttgttgttcttttttgagacagagtctcactcttttgcccaggctgcagtacagtggtgtgacctcagctcactgtaacctccacctcctgggttcaagtgattctcgtgcctcagccatcctagtagctgggattacaggtgtgcgccactatgcccagctaatttttgtatttttggtagagatagtgtttcaccaggttggccaggctggtcttgagctcctgacctcaagtgatctgcctgtcttggcttcccaaagtgctgggattacaggcatgagccactgaggcccacacagtattagttcacctcaaaatatagtggcttgaaacaacagtcaacctttattaggtgatggttttgtgggtcaggaatttgggcatggctttgcgatgtgctgttggctcaaggtctctcatgaggtgagatattaagaagttggctgggctgcagtcatctgaaggcttgaccgtagctggaggatctgcatccacagttattcacatgcctggcaggttggtgctggctgttggcaggagggagcctctccatgggattgcttgagtgtcctcacaacatggctggctttctccagagcaagcaatccaagagaacatggtaggagctgcagtgccctctatgacctagccttagagcatctacaccatttccctaatatcatactggtggcactggttagccctgtttcatatggaaagagactttcctagagcatgagtaatgaggcaaggattattgaaggccaccttggaggcaggcgactacaaatatgaggttacaacaaatgaaatctcatataggaaatgctaagaggcattcctatctgctaagtagcctagactctaggtgatgaaataaaattagtgggctatcacctggctttagatgtgcctgaccatttgaaattttattgtgaaatgatccactctgcctcactgggggctaagtattctgcttctcttgtttatgagaatccagtatttgtctttgtctttctctcactggtgtgatcccccaaaatgggaagagtggagggtgcttatagtttttcaggtgcacatagagacagtcagaacatctaggaagccagaccccgggagcagggctgtcttgaaaaagtgccacttctaaaatgggtttatatagtgcacatctgtgggatcatccagtctcctgggtgccccacccgcattcccaaataacatggctgtcctagaagctgccatgttcttaatgatgtcacccccaagctgcagttgactggagcaggagggggtctgtgagccaaggcaggccaacgagtcctttccctggaattgatggcctcaaggggaagttcttccctgctagagaaagcttaacataaaaaccctgggaactgtggactgccatgtttcctacactggaacaagccagtcagcacccagagatcatgagcaacacacacacacacacacacacacacacacacacacccaacacacagatcatgggggctacagaagtgcttgtgtccctggtctctgggctcttggcccagctgcttttctgatttccccacaatttgtttgttcagctcatcctcagattccaggagccaggagcttacagttttgttgaactaggttaggctgggattgttttcacttagaacaaaaagagtaatggggaaagttaaagacctttcctggtagcctttagatccttggttggatgcagagacagagaaacaattctgagagggaaggaggaaaagcagctggtgggggtgaggatgggtggagctcttaggagaaaagtgatggggcagacaggaagcaggatggcacagcccgtctgtattagtccgttttcaggccgcttttaaagacatacccaagactgggcagtttacaaaagaaagaggtttaacggactcacagttccatgtggctagggatgcctcacagtcatgatggaaggtgaaaggcacgtctcacatggcgggagacaagagaagagagcgtgtgcagcagaactgccctttataaaaccatcagatcgggccaggtgcagtggctcagcctgtaatcctgtaatcccagcactttgggaggccaagatgggcagatcatttgaggttaggagttcgggaccagcctggccaatatggtgaaaccccatctctactaaaaatacaaaaattagctgggcatggtggcgtgcgcctgtagtcccagctacttgggaggctgagacaggagaatcacttgaacccaggaggcagaggttgcagtgagccgagattgcaccactgcattccagcctgggcaacagagtgagactccatctcaaaatctcaaaaaacaaacaaaatatcagatctcgtgagacttattcactatcccgagaacagtaccagaaagacccaccctcatgattcaattacctcccaccaccgggtccttcccacaacacaagaaaattgtgagagatacaattcatgatgagatttgggtggggacacagctaaaccatgtcaccctctgccactggggtgcttatcacttcccctgagatgggcgagcctgtcccctccctctgagagaggcgagcctgtcccctccaccacgtggagagatgcagccccccttccctcctgccttctcttcagtgtttgactctggccaggccacaattcacaagctggtggctgtggtacctcaggaaatctggagttgctcctaccactttcattctccacccaatgtggacaggagtccattcttccctcccttctcaggttccatcccatctattgccctaagttgggccagtgaatccctcttgactgaggcctgagagggccgctcagatgggagccggagccagagactagagaacactttgcccaggcgggcacaagctctggggttgaccaggtacgtctgaccctggggcccctgggggacacccccatcatgcactgctcgccattctcactggggagcagaaaggaagcaaggccagtgcccacccatctgaagcaccgtgcagggcatcagccaggtcctggcagaaaacagatggccggccccatgtgtgaatggaggagtttaatgagggcctatttacaaagcgtgggagggaaatcagtagctgctgatgcaacacccctgagcctccaccaccccgcaacctgcagggccaagggaagggactgacgcgggatcgtgggagaagactgcccacaggagtcgggtctggagaagagggtccgggagcctgcggtgcccaggcggggacggagccagcagaaaaccaccccaccactccacccccacagcagggtgggagagggctagaggggctctggaggggcggcccacgtggtcagcacacacgagaagctggggccgtgggggtggatgcaggtgtttctccagcggggtgcatggtgagcattgtgctgaccaggcgtgtcacttgtccctgcctcaaggactctggaaaagctgaccacatcaataattacagaagctggaggtggcaagacctcatggcatctctgacttcatcttcctgttagggcagaagaaggtctcctgggagaaggaggtgacatctaaagttagtctaaggccaggaggaattcagcccagactgccctttctaaacctagggccggcttctttgaaaacgtggcaggttcttaaaagcatctgaaggaaatgtgtcttcatagccaggacatatttttcctggcagattctgagattgatgatgcaattagggcaggccaagagaatgaagtattagggctataaactaagatgcacatagatgtttccactctttggaaggcacagatgtagaaataattctttgttccttaagctcaatgtaatagtctgcattttgtgttagagcagcatctccccgcaaaggccacccctgtgtttggcataaatcacaatgcagggagaaggctcattcagtggtgtcttccctgttggcacctggcacgtatctggattatggattgtcatgggtgctccctggcaccgtggctgttagacctgagttctgggcagggagagctccaggctggagtgcaatggcacaatctcagcttactgcaacctctgcctcccgagttcaatcgattctcctgcctcagcctcccaagtagctgggattacaggcacctgccaccatgcttggctaattttttgtatttttagtggagacggggtttcactatgttgggcaggctggtctcgaactcctgacgtcaggtgatccgcccgcctcggcctcccaaagtgctgggattacaggtgtgaaccaccgcccctggctaagagagctttaaatgaacagaacagcagaggtgcctgtgtttcggggaggggacaaggcccatctctctctctctggttggaagggactctcttgcagatggaggtcacgagggcactctttgcatacagtttacctttcttttcattgaaatcattggctgctatttcccaagctacatctaattgtaaaattctgggttgttggcacactcttacttgctgcttacgtttgctggttaagctggtttaagctttctcccaccagctgggcaagggtgttctcagggcagtggtttccagggtggccccagccgtgtggagtgtgatctgccttgagctcggcccatccaggggagccaccatggtacctttcctctgtaggtggcctctcaggactcccctcagggggccactgtggagacatggcctgtcactaggtgtcttaatcagtgcgaaaagcccagctggaggccttccatccgttttccacctcccaacacaaatgctcttcaagtggtggcctggcacggactctttgagaaaggccttttgatcccggcaggggaggcctgtccccgcgtgctccctctgccgccctgtggacctgcgtgcccatccaccggcggggcctctgccgggaggcaggtgacctgaaagggatgttatttttttaacgtgggttttagtacccacagcaagagtatttttagctggttattgaggctgattagtgagccccaggcctccatttggttaaatagagccaccttcacagatgtattttcgtacagtgcaaatctagtgttctggatggtatagagttaccccaaatgatggccggccatttgcccagggcctgcgtcctgcagagcagtctagctacattcccacggtgccggaccaacggcgggctgtccaggggcagcaggaccctgggtgcttctcattctggaaaacagcaggcagctggctctagagtgctcagcccctttggagacgccactgctgccccgtcgcttgctagctgtgctgtattggaacctcttagacccttagtttcttcatctgcaaatcgggactaataatacctaccatgtagatataataataataccctgccatgtagggtgagcctggaatcagcactccatatggggtgtgtgtctgtgtgtgggtgtctgtatgtgtgtgtgtaggggtgcgggtgtgtttgtgtggatgggtatctgtgggtgtgtggtgtttgtgtgtgggtgtctgtgtgtaggtgtgtgtgggtatgtgtgtgtgtgtctgggtctgggggggtgcgggtgtgtttgtgtggatgggtatctgtgggtgtgtggttgtgtgtgtgtgtctgtgggtgtgtgtgggtatctgtgtgtgtctgcgtctgtgtggggggtgtgtgtgtgtgtgtgggtatctgtgggtatgtgtgtctgtgtgtgggtttgagtgtgtgtgtgggtgtctgtgtatgggggtgtgtatctgtgtgtgggtacgtgtgggtgtgggtgtgtgggtgtctgtgtgtggatgtatctgtgtgtgtgtgggcgtgtgtgtgggtgtgtatctgtgtgtctgtgtgggcacgtgggtgtgtgtatctgtgtgtctgtgtgtgggcatgtgggtgtgtgggtgtgtgtgggtgtcggtgtgtgtatctgtgtctgtgtgtgggcatgtgtgtgggggtgtgtgggtacgtgtatgggtgtgtgtatctgcttagtgggcacgtgtgtggatgtgtgtgggtgtgtgtatctgcgtgtctgtgggcacgtgtgtgtgggtgtgtgtgggtgtgtatctgtgtgtgggggcacgtgtatgtttgggtgtgtgtgtgtctgtgtgtgggtgtgtgtctgtgtgtgggcacgtgtatgtttgggtgtgtgggtgtgtgtgtgggtgtgtgtgtgggtgtgtgtatctgtgtctgtgggcacgtgtgtgtgggtgtgtgtgggtgtgtatctgtgtgtgtgggggcacgtgtatgtttgggtgtgtgtgtgtctgtgtgtgggtgtgtatctgtgtgtgtgtgggcacgtgtatgtttgggtgtgtgggtgtgtgtgtgggtgtgtgtatctgtgtctgtgggcacgtgtgtgtgcacacatgtgcactcaggtttaggagagcgacagggggcacagaggaagaaaataacaggaaaaagtcaagaagaaagagccaccttaaagcatctcaggaattcatctctcgagtcaaatcatcaagaagtgcccagtccctcaaggctcatcttgatgtggaagaggagttgacctctggggagaggctctgcccacgcggcgcagtgggaatccagaggccagcgcgccagtccagcagctgtgaccttggaccttgggcaagtccctgacttctctgagcctctgtgtccagccctataaaatgaggggtgggattccttacagaaccactgccctatctccctgtgatctaaatgattgtagtgttcatgtttcttcatgggagaaaatcattggatcttggctctccattagaagagagagggcaagacaaggacactcgctcactgtggttggaaacgagcctggctgcctctgtggtcactgcgagtgccgcctgcgtgctccctttggctggcctgggaggaatcggaccctagacactgaggtgtgaagtttccctgagggccggctgggcatctgactgcatggtgggacgcctggggaggagttcgggtccgtctatgctggtgtcatttccttcctcttttgaaatagctgtacttttggacagaggctgacaaatccttgggtggtggattttgaaatggttataaacaatttgcaattagctcttttgtctaaatgagaaagggccgcttactcaggctttttattgactcgaggccctttatccatgtggcgagtgcgtcagatgtgagcgaaggagcccctctgggattcagggaaattaaaaagtctgttttttggagacctcccatctttagagcttgggccccctggcttggctagttatcagagtcctaaattctgtggtgtggttgaggagaagccctgcgcttggaggttcgagtcccagccctgccacctcccgctgcatgaccctatgcaagtcccttcccaccgccggccctcgggatctccacctacagacgaggggttgggatggcagcccctgttctcctgcgtcactgccctggctctttcgaggttcagataagaacatcttaaaaaacctgtgtatgttcactttgtaaactgaaaagctggaaaagaccaggcatccacattattgtttatccttgcaaggtgtaataatcacaatggcggtaactatagcaactgtttattattatttatgatgggccaggccccaggccaagagcttgatcacttccgtctgtataatcagtgtatacctaggtgctggtaccatctgcgttttatagaagggttaagcaaattgtctacgatcacacagcttacaaggtctgagtgacctaaggcagcttctcggcagccttccagtctggtgggctgttatttttctggtagtttcctttgattcatctaagtcagtggtcttcaaccccggctgcccaggtgccagccctcatggcccactggaaagcctggtttcatgggtctagggtggggcctagcatcagtgtttgctcagggctccctgctgattctgatgtgcagtctgcatggagcaccgccatcctgagacccagcatctgtgagagagggcaaagtagtttggactaaacatcggggctccgtggccaggtcttcccccccggtttcctgacctgcaggagaagggggttggtcaggtggcctctaggggatttcctccaggggctgtgaggttctgtaactataagaagctcatgagcaaacctgttattgttcttttttctccttctgttttaggcagaatatgaagttactccagatgaaaaactgggagagaaagggaaggaaattatgaccaagtacctcaccccaaaggtaaggagtcttccaaaccccacagcaggtggcacaggaggccttatgcaaaaataggagcccctaagtctgtgccaggccacatggggagctgttaagtgctgggctggtggctgttgttgacctcctgagatcacagttcccatcctcccccagagagtgcccaagcctggcagggccaagatggggatggtctaggccaggactggagtaggggcgggatgcctgcttcttggggcccagccccttcaagggtcaccatgctgctgtgtgcccacacccaaccatttgtggtagggcagatggaggcctggccaagttcaggagaagtgcccagaaggaagggcttagcagggcagttctgagaggtcagcgtggaggggaagtgttgggggttgactgggagggaaagggggtgcccaacgacatcaaagaatgaagagaattctgaaacatattctggagtattctgaagggtcaggggccaccccgaccccacctcggggccacccactggatagttgaagcatcggggtaccattgtcctcagggtccagcagcctcggttctccaagatctgcttcctcttgactcaccttcacagaagtgtgttctcaacccatttagtgttctagtgtcagtggttctgcccacttggtcaagccacattccctccctgggcctctgtttccctttcttaaaagtggccttcctgtcagactcacctcccggaggtgttgagagcctgagatgggacctgtgtgggaatagctttgcgtgtgtcccatcccccggggccagtggtggcttcaccctgctcaggaccctgtgggccaaccagctccccggaagagtatacctcctggtgcccatcccaggctgccagtggactgaggtcaccacagcctgtggaaggtcttggccatcagtcccctcaacctcctgcacctcttgcaccaaatgtagccctcgttcttctccagcatcagcagttggtagtggccattgcccttgcagggtgagaccagcctcacgcccagaagtgttgccctttgtcacgccccactctggacagcctgctagacggcattcctaatgcgcacacagtcgccatcaccttgttgcctccccttgctgtttctctgctgcatccatcataatccatgcacttctctttctgtgaactgcaaacacccccagcccttttgcacttttcagaaatgacagaatttatgtttataaaacacttctaggcatagaatagggctagtttgctctggacaaggtgtggccctgggtaggcacagctgcccccaccttgggggccttgctatgctccagatatgggcctgttgctgtctgtgaggttctcaggtggacacagacgaggagacgttctcagcagggtccctgttcacccagtcgcagccgatgtcatattggtggggctctggctagatacatttttgatctcctggccaccactcaagatagtgtggacactctgggcataaacacatgccctgagcttaaaggggtgcatgcaccctagagggcataatgatgacagctccctggctgggctcctatggtgtgccacatgcctccgagatgtctctgatgattcgcgtatccacgagattgccctatttacagacaggccactgaggccacagagctgaatagcgtgagaggccactctgctgaaggggtcttcagctaccctctgcagaggcatcttcccacggtggctcagcttggcccagtccagcgcttcatctgtgcccccatagggctacccagtcacatgtgtcccccccaaacaatggcaactagaatgtattgaggactccttgtgtcaggcaccactgtctatagtccttgctgtcactgtgggatgcagattatatttgttccatcttaccgataaggaaggagaggctcaggggagctgtcacatcccaagtcacacaactagtgagtggcggagctagaatttgaacccaagtctgggtgattctagagccctgagtgtttcccctgggtgtagtctcctcacccggcttcactgtcctgccactgtctgtggcctggctctgatctgcagtgagggcggagtgctccctttgcctgaccttgctgtctggataggctcttgtggcttagccaagaacagggtacaggcaggcactggggcagccactgagggctgccaccgggttgccccgtggccaaccttgtccagaagcccctgctggcagcccctgacctgagctctccagacctccctagctctgctcagccttgcctccatctcctggagggatggggcccagacacccccatcagctcagacggttttacaagtgcctcagagcctgccagcattttttcccttaagttctcctcaatttaaaaaatttaagccacaccatatgttacggccagggaggcctccaggggaggtggttgatccatgccttgggtcagctgtttccctacaataaactttgcactgctttcccagttcttcccataacagcttgctctggagcctcatttacctctcacgtgccccagtgccccagatgcagcgaagcaaggtgctggctgaggagctgagcgagtgactgaggccccagcactggctcagaagactttgaccaactgcaaagccactgtccccaagcccagattgtccttgccttgggacccctcctcagtatgtagcttgtgtgtctcagctctgagcagtgcttcccaaaaggtagaccataggagagtggccagtggagaagctctgtgaaaaagaaccctcagtggtcaattacacgtgggcagcactgtaataccatgtctcccccggtagattcactcagcatgtgagcatattcaaggctctgagaagtcctgcaagaaagaaacctctttaactgttaccaaagcatttctcaaagttattgaccataattttttttcaattttccattctgctgagcacactttgggctacagaacacatccaagagcctcacgcccacacctccttctgctccagcatcctttcctgggacctctcctgtggcttcacactggactgtggccacaccatttcctaggctcacctggatgtccataccttgtggcctttgttcaggctgtgccccagaaggccctttatgaaggcgctgtcccctactctgtctttctcgcttctgtatccctgcatgtattgaggacacttgtgtcaggcaccactgtctgcagtcatctccaacatccccagctgcacagagcctcttctgcctcttgtcagagtccgttggcctcacctgggtggtctctgagcacactgttccattgttgtgattctgtgccccatgatggggattctgaggagcccaccttcagagtagggccaacacataagcagattaaccaaatgccccacgatgggagcagtggtggagctgtgctcagggaagtgtggggtcaggtgagctagaggacgcttccaggaggtgatgctgctgaatcagatcttaaaggatgtggaggaggaagctggacacaaaagaaggggaaggaggagcggccttcatgggtgcagtgcagtgggcatttggggctatctggagatacttgtaattggcagaattgtgggggagggaagtgctcctagcatctgatgcgtagaggccatggatgccgttgaacattctagagtgcacatggcagcttcctacccagagttacctgggggcaaaatgtcaatagggctgaggttgagaaaccttggcacagaggtaggaaagcgcacaggatgggcagtgctgtgggggtgggaatggggagggggcccctctgagctgtaggccctgggaagccatgttgaggtggcagcagtgtggagttgccagtgcttcgagtgccacttgtattttaggacgatctccctgaccacatggaggaggaataagggggatgaggaaggactggaggcaagaggccatctggggaacagccccaggtccccaagctgggccagcagccttggggatggggaggaacaaagggccttgcgaaacggcagaaggaggatgcccttgggcttttgtcttgagtctctgggtgtatgggggtgtccccaggaaagacagagcacaggatgagggccgtgggaaggtccacctgctctcggcagaggcaggggaattcattttggatggagacagtggcatctgctctctgtgtccccgccccagcatgacgctggacacatggttctcgatcaatgtgagttggttggaatgaaacactgaggggagctctggaagctgccctccatgggcccgtcagctctcctgtctcatgtctctggggagccacgcttggcgagctcacatcctgaggtgtctgccatcttaaaattgctggaagccaggatagaaagcccctgcctaagcaatgcctatgccttgagctccgttctccctcaccacggaggacgccctacaaacccgtgcctgaagtttttatctcaagaggcaaaccccactccgtagaccctgcctcgaatcctgcatcagtcgcccatacaaggccagctttgctttgggggtgttacagggcaacagccaagggtgggcttggaaggggttgaaagctgttggagagctcacagaagggcagcagagtgctgagaaggacgtgagctttagagtcaggtagacctgggttcaaagccagatgtcacctctttgggctgcatgggtttgggaaagttgcttaacctctcagtgcctcagtttcctcatctgtcaagggtgtgggccatgatgaggatcataaataaaagcagcaagtactgagcatggtagctggggcatcttaagtgcccagcagcagtgcttgtcatctgcctttccccaccttctccgtgccttcaaagtcaggctgttgaatgaggaaatcgttcagatgtcgaactgccagctgtggagtgcgagaggccaaggaagggtcgggagggcctccagctgcagagggctggacagaggcagtgagccagtcaggatgatttatactagctgccacaacaaacaaacccccaaatctcaggggctcctcccagcaaaggttcatttctttctcacgcatcatctggttaggtcatcagctcttctgggtcctccctgggtgactcagggatcctggctgctcctgtggccccaccatctggagtgtgttgtcccatggtcagtgccacagaggaagagagggatgaaggaggcacagaagcttttaagtgcttgacccagaagcaacactcatcacttcctctcgcagtccatggccagtggggaggctgggaaaggcagaggagcatctggaatattaggtgagcacaccagtaaggctccctgcgtacattcccatccctcgagccccaggttaaaaacatcacgtggcaggctcatctctggtgctgattagacagccgtgagcgtggcttgtcttagggattgtctcgggtttgtcagctcacagaagctggccagcgggccacagttggatctgagtgtgtgctgggctctgaagagagctgagcagctcaccttctaccctccagttctacagcccagaagtgatacaggtgacaggtattcaggagaggggagggtcactccgagctgaggtggcccaggaaatgttcccattgtaataataataataagtgaaaacagaattatatttcatccagcattacagatgactttttgaaataccaattttatggccgggtgcagtgtctcacacctgtaatcccagcactttgggaggctgaggcaggcggatcacctgaggtcaggggttcgagaccagcctggccaacatggcgaaaccctgtctccactaaaaatacaaaaaatcagctgggcatggtggcccacacctgtaatcccagctactccagaggctgaggtacaagaatcgcttgaaccagggacggggaggttgcagtgagccaaggtcgtgccactgcactccagcctgggtgacagagcaagactccatttcaaaacaaaaaacaaaacaaaacaaaaataccaatttttttgagatctattggtataattctcataccatagaactaattcttttaaagtacaattctatggttttaaaaagattcaaaatcttataaccatcactgctttctgattccagggcattttatcaccccaagaagaaactgttgtacctgttagcagtcactccctgttcccctttcctcccaggccctgacagccactaatctactttctgtctccaggcctatttcagacatttcatataaatggaatatcatataatatgtggccatctgtgactggcttcttttttttttgagacggagtctcgctctgtcccccaggctggagtgcagtggtgtgatctcggctcactgcaagctccgcctcccgggttcacgccattctcctgcctcagcctcccgagtagctgggactacaggtgcctgccaccacgccctgctaatttttgtatttttagtagagacggggtttcaccgtgttagccaggatggtctcgatctcctgacctcgtgatccacccgcctcagcctcccaaagtgctaggattacagacgtgagccaccgcaccagccgactggtttcttttgtagcataatgtttttaagattcatccacattgtaacatgtatcagcacttcactcctttttatggctgaatgatattccattgtaaagatacaacacatttatttagttatctgctcatcatttgatggacacttgtgttatttctacctttttgttgttgttgttgttgttgagatggagtttcgctcttgttgcccaggctggagtacaatggcgggatctcggctcactgtaacctccaccccccgggttcaagtgatcctcctgccaccgcctcccaagtagctgggattacagatgcccatcaccatgcctggctaatttttgtattgttattagagatggggttttcgccactttggccaggctggtctcgaactcctggcctcaagtgatccaccctccttagttttccaaagtgctgggattacaggcacgagccaccgtgtccaacctgcttctattttttgtttctacatttttgctcttgtggaataataatgctgtgaaaatgcaggtacaagtttttgtgtagacatgtttcattggggtatatacataggagtagaattgctgggtcatgtggtaactctatgtttaaacttttgaggaactgctgggctgttcttcaaagcactgtaccattttaaattcccaccagcagggttccagttttgccaaaacctcatcaacacttgctattttctgtgttttttattttatccatcttagtgggtgtgaagtggtgtcttgatgtgattctgattcatacttccctaataattaataatgttgaacaccctttcttgtgctttttggccacttgtgtaacttctgtgggaaatgtctattcagattctttgttcatttttgaattgggttgtttgtctttaatgtcaagtcataagagttcttcatatgttcaggatacaaggtccttatcagtatatgacttacacatattttctcccattctgtgggttgtcttttcactttcttgatagcgtcctttgaatcacaaaggtttttcgttttgatgacattcagccttcatttttgttacttgtttttaaataacttgttttcattttgtcttacctgtccttgtaagaaggcctcagtttttgaagggaaagggtgtgtatggaaacaaagtaaagaaatcctaatgtacatttagccccatgacccggtcttcctttgaagaacgagagccccactgcctgttggaaagatcagggccagggggccaggcctggtccttcatggacattcagccccttatcccctggttgacatgacaacatcccaggggctttgagcccttccattcctaggactgcacgggcctcttacagacttgctcctggaacttcctggcagctccccaagatgggtattagtgtacccattttacagatcaggtaactgagatttgggaagagaagaggctggtccagaatggggaagcgcctgcgtgacctgctttggcagtgttacttgtaggacattttgctgcggctcattttaattgggccggtgagcaacagtgctgatctccatggttgcagtgccccaccgcaattactaaggtctggcaaggggggtgccagttttgatgtggctttgttagggactatcagtggattctaggggaagctcaaacccagtcctggtcctgctgaaagggcctgcgtgggttcttcccggacaagggggtggacaggtgggttggggcaggcttctggggaactggtatggcgtccttctgtggggtactgggaaggccgttgtgcaggcagctcttagagcgcatttcttgccaaaggtctgcaggcaggatattgttctctgggccctccatagatgcagggctgcctctttgtttcaataaacaatgatagggtaagacagggaagttggttcttgtgaagggggaagttacccatcagcctgtttccacacaaacgaaatctattcgtagtgcttgttgggctctctggaaaacatccacattttataaagtcaagagcttgaatgaaaggaaataataacgactccaaattccctcctctggctccccacccccacccaggcaccagcgtcaggaagccgaacaaacccacgcaggctgggccacggctcctcggcctctggcacaggcagtcagcttcatccttgtccccaggacctcatgcaaccccagtcctgccactttccagctctgcatccttggagcctcagtttccccaactgagtatggggctgataaaaatggcgcctacctgtgcttgtggccatcagtcattctctagcacttgcgtggttttggccatgtttgcagactacccttaacagttacctatacaacgattttctttaaatcaacttatcttttaacttaaaatagatgcgttttaaaaggaaaccttgtaccaggaacatgcctggagaaccagtattgatttgtcatacataaaggtaactggaaaaattaagattaaatccaagctagatactctattgtctgcctgaggttctgagcctgaaggctttgtccttgtcattttaaaggagattagtgaatgtgagagccctgatgacaggacggtagcactgcctgcgactttctacttcatgatggaaggcttgcaggagatccaaagagaatcactttttcaccgagtgattcaatattatctaattgtgtccctgtacttcctaagacctctcatcatctttagaagatgctgggctaactctctgcttcctagctatgatgcgttatggaaatggaaatgctggcttgtttttgttagagacagcatgacctagggcaaagagcactggactgggagtcaggctcattcctgatctcccttcctggggtccatggccctggtcctgcttagagtctgcctgatcatccaaccaattcatgatctccagggcaaccaagggtgtgaaatatgggaagcttgggcaaatggctcccttccaagtacctgtcccattctccctggggcttggggtcccagacactggccctggacccggctcttcatctctactgagattgcccggccctcatttcccagtccccggaacaggtcatcctgttgtcaattaatctagtgagctcagactccaccttcacttgagcagagggtctggctgggcagctgcccctgctgggccatctaccagcatttccagcttcctgtcacagccttgcgtacaggctggagggcggaagaggattgaaaagaaaacttgagaaagggacttccaggagttttctcaagcaacagtagtgagggacaggggttgggcctcttccacttccacttctgggagcagcagagagaggaattcacaaatcaagccacatgtgtgctcatgagctgtcttgggacagctagcatttattgagctactactgtagcctagaacttcatattccatgttttgctaagtcctcatcacagccatataaaataacaagaagtggaggctcactcaggatgggcgcccagggaaatctcaggggctgcccagttctgggccccgcacgcagttttatctgcagattcccagcgtgcaaacagataaaaagatctgtggttgacaaagctgggggctggacttctctttttcctcccttccgcttccccttccccttccccaggctctgactttgaggagaacatttagggttctgtggatcccagtttaagcaccatggagctgagctaaactcctcatttcctagataaagaaactgaggccccgagaggcccagcttggaagaggagactggaatcttccttgtggggctttctataactctgtgctagaaacaaggagaggaggcctcaaaagggatgcttactgacttggttttccttctcccactggggatggccggcagctgggtttcaattcctctgaggtgctttttctttaagccagtaagtgtctaaatgctgagacattcgtaatgtctgtgcaaagcagagaagttggctgttgccggaagttctactagttaagcactaagtcattaactctctgggttttagtggaagaggtgagagaaaatagcattaatttagcacctactgtatgcgacatgctttatagctttagtgcattctatcttcatgactatcctatgtagtagacactattgtccttgttttacccaggcagtcagagttctttagctcataatggtaaaacaggggaattgaaaacagggaggctgggcatggtggctcatgcctgtaatctcaacactttgggaggccaaggcaggaggattacttgaggccaggagtttgagacctacctgggcaacacagcgagacccccatctctacaaagaaaagaaaacttggggggctgggtgtggtggctcacgcctgtaattccagcactttgggaggccaaggcgggcaaatcagctgaggtcgggagttcaagaccagcctgaccaacatggagaaaccccatctctattaaaaatacgaaattaaccgggcgtggtggtggatgcctgtattcccagctactcgggagggtgaagcaggagaatcgctcgaacccaggaggcagaggttgtggtgagcccagattgcatcattgcactccagcctaggcaacaagagtgaaactccatctcaaaaaaaaaaaaaaaaaaaaaaattaattaggtgggtatggtggcgcatgcctgtagtccttgctacacaggaagctgaggtgggagaatcacctgagctctggagttcaaggctgcagtgtgagctatgattgcaccactgctctctatcctgggtgacagagcaaaaccctgtctcaaaaaaaaaaaaaaaaaaaaaaggcagaaaacacagatgcaaacagatactagtgtgcaaatatttatagcagcattatcacaatggccaaaaaatggcaacaaccaaagtatccatcaacggatgaatggataagcaaaagtggtctatcactacactgcagtgttcaaccatataaaggaatgaagcgctaatacatgccccaatgtggatgaaccttgaaaacattatgtgaactgaaagaagccagacataaaaggccacatattgtgtgattccatttctatgaggtatctagaatagacaaatccatagaggcagaaagtaagttagcatctaccagggggcacgtgggagggagggagtagggagttgctgcttaacaggtacagagtgtctgttgggatgataaatatttttggaacaagatagaggtgatggttgccatgatgaacgtaatgaatgccactgaattgtacactttaaaatggttgaaatggtgaagtttatgctatgtctattttaccacaatgaaagaaaaagagcaagaaaagagtggaatgtaagctggcctgtccgatgctggagcctgtgatctttctcttcctctgcgttgtcttcttgaaagttaaccaaagacaaaagttcccactgaatcagcttcccaggtgtagcagggggcaagcagcaaggccggggaatgagcaagccccggaggcggtgtcgggctgacgtccagaggctgtgcatgccagcgccctccggggcccagcccagctcctgacccccaacctgggcctcggcttccactctgcgctgtgtccttagcatcttctcacgtcacagtctcctgcgcggcatatttcatgactgtgtaattgtccttcaaatagacacaccccacccctcaccaacctttcctggaaaacaaattgtctttgcccacagcctgatttcatcttggcgcctcctgacgcccttgaggctgatgtgccttgctggagctcctcacagtgggccagggcaggcccatctaggtcctttttcctttctcatgaccatccaggtcagaaaattggaggttcctttgatgctggcagagctggctctgcctctgaccctgtccttaatgtgtgtgcatagtgtttcctgtccagaatgcctctcttttggagtggcggcagacagaagactcagccacaggcttcctgagggcacccccaactctgtcctgggtggcagtgatcctggtccctgtggcttggcaggccctccccatccgtggaccttgggcagagaagtggcatcacgtggctgaggtgaggggcaggttctcttgaatttcctggctcgtaggagattcctgccccctgccccccaacccctttattttgcagcccgaagggatgaagtcttcactggagaaaaatccaacatgatttcggattgaggagggtggtgggtgttctggaagaaggaaagttggcgggccctgccctcgcctatcacgcacaaagaatgagggacactccccaccgtttccccaccgtgaacatccccagcacctcagggcctgggctccatgtgtcagtgacctgcatgtggttgcattggcctgagcggagctggctgcatgcaaaccactggccaggaagaatcccactcctgctgctgctcctgcagctgcgccgggtcccgcgagcccccgcgtgcgcggcctgtgtaaacagtgcgtcatctcctgttgcacactttgggcctgcgggtcacgaccagggattatcaaattgacagagctcagctggcctctcactccacgtccgggcacattgcattttgttaattatcgtcttttgcttttgacgtaaagggtcggggtctgggtcagggtcactgtgtattttcctttccttctcattaaagttgcccagctctcagggcccccagttaaattctgccagcgtttaaagatatcttccctcgcttcccgacccctaagcgcacttcttccttatttctgtgaagccactggaatagcaaaggaaatgtgggtcagggtctttcaaacccagtccattttatttttcttgaagggctgcagctatttctgaagggctgggtttttctactttgttggcccagagaacatgacacgctgggtctcaggctgaccaggtcagcagggcactgtgaaggggctggaaccacccccgacgctttgcagccccaaggcaaggcttgctcccagcacttcccagccacacggccctcacttggttgctcatagccctgagcctgctgtctgcctgtgatcctcagtgcaaccctaccatctgaaaggggtctagaaaagtgtcagttctgccattaggaaaagtgaattcatccagagctctagtcttggaagagttcctagcgcacaaatggcatgagctggaggatagaagggtcctccctattgcctggctaaaccccctttaccctttgggccatgatcaaacctctccacagccgtggagccacctgtgtctaaagaggccacctctgtgagcgctctctcctaggtgctgaggggctgtgacctgcactctacagcctgcagtccttgctgaccttgaactcctgccattggccaacagagttggtctctggggtccttagggtggacctcatggcctgggcacagaatgggcactcagggaacccgtatggctgatggaccccagctgaagaagctttccgactggtcactggagcagtggccccacctccacctctgctcacaaagacagctcccatgccttgaagtctcttcctggcctggtggaaaacccagctaccctcatggtcaccaccaaagaggtacaagagatcctcagccaaagaattaaggaggttgcaagagtggtggtgtgtgtctgcaccatgatggagtcacaggcctttcgtggatgctggttacttctgaacactgtgtcatggtgtcactcccactttctcctccgccagacacacaagactccagagagcccagagaccccttagactctaggtctttggactgttcaccaaggaaagataaaaatggcagactggatgccatcttcctaaaggcatcatggcctctggaagggccctggagaggcccctttgagagttggagacaagggaagatccagagtttctttgaggggggactgaagcttaaataacttgctgagcatgctttttaagaaaaagaataggaggttaggtacaaaagtgaatattgagaaggagaaaagaaatcacaacaaattactgagggcttggagattcatatccttttcatctgtgacctcaatttcccggaagtgcttctgtagaaatgctctgtctcccaagatagagcattctgtagctcccaggactacaaataaaggactactccgtctcaattaacaaacaaacaaacaaaaccctaaagcttcggcctcctcagcttcattgcagatctgcttcttttttttttttttttttttttttttgagatagagtcttgctctgtcgcccagtctggggtccagtggtgcgatctcggctcacagcaacctccacctcctggagtcaagcaatcctctcgcctcagcctcctgcatagctgggactataggcatacaccaccacgcctggctaatttttgtatttttagtagagacggggtttcatcatgttggccaggctggtctcgaactcctgacctcaggtgatccacctccctcggcctcccaaagtgctgggattccaggcgtgagccactgcgcccggcctcagatccgcttctgattggaggctgtgcccaccttcatgggaaacggtgagcatcaccttcctttgaactcaaaagaggcacagtgagagccttccagcctcgatcacaaggacctctacccacaggctgccggtccggtgtgtctctgcctggcagggctgtgcctggcacggtgcccgggccgtgcagtccatcgcctgggctgaccacgaggacaccccggtgaagagctgggcgtgcttgggccgagggctgctggatgttggcatcaggcccagggtggagggagggacaggccacgagcccgcacagctcgtgagcgtgtggccggactgatttatttttctccccagtgaccccgaaaaccaaaccctgccttctttcctttggtctgttcttgtctggggcttgtggatcacgtctcctgcctggccatggacagagaaaggaaccactccagacggacgtgagggtgtgtggcagtggcttttccacatggccctgaaggttttgattaaaaaggtggaagaatggtgctttttcttcctgtcagccaggccttaaatcaaccctcaagtgaggaaatgctctctgcgcctgctgctcagcaaacctttttctctggttgtgaccgtatgagcatgtttaattgcaagccagggtttagggttggaacagcccccattcgccccaccaccctctgctttccccaccccagaccccgtcgctgcagctgggtgagcagggctgagtgagctcagggaatcggagctcggcgagacgaggggagctcttggccgtgtgaagagcacttggaggcctcctgctcacctggcctaagcccctgattttacagatggtgaattcgtctggattcttggcagcaagtggcagatactttcctcccagttgctcaaacaaagagggaatttactgcagagatgaggaggagggcgttctctcctatggtcaaatgaaaccatgagaccgacacggcggtacctaggctgggaacccccgaaccagggcacttctcccccacccagcaaccctatcctacagtttcttcctgagatggccacggcccctccatctggttttaattaagaaaattccttagcactgtgattggcccagcatgttacaaaggcaggaggcagagcagatgaccccataaaggaccttctggtggacagacctgctattctctatctccttctttcctgctgtgaacgttcacactcatgcacacaggcgcgtgcacacacacacacacttatccaacaagcatattgagcacctactatgtgccaggaacatcatcagttcattcagcaaagcagagtggagagattgcagggtttggaactgggcaggcctggatttgcgtctcaggtctgctacttgctaagcgttccgtctgcgggcatttgcggaaccctcacagcacacctggtgccgtgctgcattccatcctgataagcaggaatgagaccacattcctcctttcacagagctctctagggctctgtttccacatctgtgaccccggaacagtaagcccccacctcacagtgttgttctggagagcaacaggagtaaaaatttatgagaaaacccacatcaaggcccagcacaacgcctgcctctctcaggggccgtgactgttaggccggcccgtccctcaggcgcccacagcagcctccagccctggctcctgctaaagacccgactcccacccctgcccccgcccaggccaggcttcccgtagctgacgcagatcccctcgaggagggtcaaggggcggccagggtatggttgtgggagtgcccctcctctgttcccgccccggaggagaaatgagggtggcctcccaagaaatgacctccaccccatgacagcagaacagggcagcccccttgtgtggaaggaaggggacccctgggagcccctttcttccagagagtctctctctcctgctcagccttcctgaaagctgagcctgtccacgttgggaaattgcaaatagtttacatggggaatgtcagctgcccacatatgaaaatatacacatcattaagccctaagtgcttgcgtctggagatagagtggacagtctcccgggccgaccttttgtccactgacggaaccatggctaatgagcgcggagctcctcagtgggatgttttcctctactgaagtgaagcatatgttggacgttagcgtgtgtgtgtgtgtgagagagagagacacatgacagcactatacaaacaccattggtcaaaacacacagagtccaccgcacctccttatccagcccccatgggcctccagggagggcttgttcctcaacaccacatcctcctgcacactgtctaggaaggaatgtggcatccttggagtacatgctggtgctcagggataaggttctctggccagattccctaggtttgaatcctgtctttgctcccaggccaactatgtgcccttgagcaagttacttaacttctgagcctatttctgcgcctgtgaagtgaggacagtaagaataataaaacctatcttaagaagatcaaacaaggttactccacataaagctcctaggacctggcatatcataagtgggtgctcaagaaaaggcaatgatggccgggtgtggtgacgcatacctgtaatcccagcactttgggaggctgaggcaggtggatcacttgaggccaggagtttgagaccagcctggccaacatggtgaaacaccgtctctactaaaaatacaaaaattagtcaggtgttgtggggcgtgcctgtaatcccagctactcagaaggctgaggcatgagaataacttgaacctgggaggtggagcttgcagtgagccaagattgtgccactgcactccagcctgggtgacagagtgagactctgtctcaaaaaaaaaaaaaaaaaaaaaagaaaaagaaaaaagaaatggcagtgatggcagtgatgatgagaatgatcgtagcagccttctccaggaggtgaggctggaagaacggtcctgcctgctgggaggatcatcttagatgtggttatgtcagaagcaggtcctaaagaactgggtggggtttggacatgccatgaaggggtgggaaggaacgaagggaccaagcaaaggtccagtagccagaaagctggagctcgcccaggaaacagccagtgtggggccagagcactggagagcaggggaagaaaaggggaagcaggtcgggcagggtgttgggggccaggtctaagaagccactagacttggtcctataggcattgggggccgctgatgctgtgtggtgcagaaaaactcctttggggaccattgtgtcaaatgaaagagcaaagagtagcagagacctgtgaggagcctcctcaatagtccaaacaagagaagagaattctccaaaccagggtagtcagctggggatggagaggaggcagtgggtggcagagacgccacggctgagattgctagatgtgagtgttcccagctgtgaaatgggggccagctggttttgactggggccaaggaggccaaagccatgtccttcctagagggctggctcaggatacctggttaagggcttataccactcagatccatgcctcccagtcagaggtgccaatcctggccccgccatgggccagcaagtgacttgcaggggaccccttctctcagtttccccatctgtgccatgagtgggttgaagggctgagccctgaggggtctttcctggagggtcctctgatctccacctcctccgccgtctcactcctgaatctctgaacgagtatcaggcctgtgtttctggacagttcccagggtgacgcggggcaaaggattatcggtggctctggggaggcctctgggtgtagctctgagttgatttcatggtctttcagtcccgcttcatccctgggtgcctccaagggcaccagccaagtacaactgattccatctccaccctgacacttgaaacaagggatgttaatacagggagatgctttgggaaccagagcctcaaacatctggagtttcgcactgatgcaggaaatgatgtcccttcctcacgtcagtcattcatggtgcagaggcagggagcagtgccgggagagcaggtgcagccgccttggcgacgccatcctcggggctgataactcagccactgatagctgccccaggagggggtcagcctcaagctacggcagcattcctgccagccgttcctgcttatttcccatgatcttcactagtccctctgactccgaacagcatctccctttctgttcagtgctgactctgtcctccaggcgctggccctgcagtccagcttctctctccttcaaggtccaggcctgtatgacctctctagggctccctctcgaattgatcgctctctctctctcttttttttttttttaatttgagactgcttctcactctgttgcccaggttggagtgcagtggctcagtgatctcggctcactgcaacctccgcctcctgggttcaagcgattctcgtgcctcagcctcctgagtagctgggactacaggcgcatgccaccatgcccagctaacttttgtatttttagtagagatggggtttcaccatgttggccaggctggactcgaactcctgacctcaagtgatccacacacctcggcctgccgaagtgctaggattacaggcgtgagccaccgcacctggctgaattgatcccctttttcccctcagttgttgttgcagaggccgtactcctctggtctgagattatagtcagttggtaattattccaggtgtgcccacctggcctcccaagtctttggggaccagaaggctggcaggccgttggggtgaaggagcatagggaagcaatggcaccaccttgtggacggcctgcttcatgggccttggctgaatgcgtggaggcagaactggggttgggctgtcgcctgcccttgtgcttgggtccctacctctgtaatgccactgagggtgggtgtctgagcatcagcctcgggtgtggtgggtgatccacacgtgcttcccggattcagtgctgagtgtggtgcccactggggtggcttcatgcccaggcctggcccctgccttcctcctcagcacccctcctccccagcctgcctcagtgtctgaaatactccagatcattcctgcttcaggttaagcacagatggcgcctgtgaagcggcagttgacctgggaggggtgcggcaatgagcatttgctgtaccaaggggtgctgggggcaagggattagccagcaagtcaccccattcactctaaacccattgctgtacaaatgcagcttcaggacaggcccctagttcttctctccaaccacactgccaccccaacagtctcatcattgaaaattccaaggcctcccgtgcattgaatcgttagtggtcagcaatacatcatccacaccatgcctgaatatcccagaggtttctgctctgatggaacagaagatgagagaggcgacctacgcggcatgatacggtttagggtcacagcagcagaggatgcatgagatgaggacaaaaaggaggggagaggcttagagaggagtgaaggtgcgaagtcaccctaggcgtacttcatccgtttcggtggggggtctgccctacttatgttccaagtgatgggaagagcttttctccgtgccctgtggtgcccagaaaaacatcccaggcaagtttcatctcttgctacctgaagaggtacattctggtcatcacagatatcaggaactgcccggatccccagaaccagtggcatagagcagagagcgagtctgggccatagggaagaggtggtaagaaggagtgagtcatcgggggtcccgaggggagttccaaaccagcacgagctctgtccgatctgcccgctggaatagcaggcagccttggctcccctggcccagtgcggccccaggttcctccagtgcaggattcaaggtcaatttcccatcccaagagagaggcagggcaggttcttttacctccaggtgaagggggcttttatacagaagaaccagctcacagagcaggcagagtgcccccagcttcaaggttacctctgtccctccccagcttcaggggggaccagaaggggagagtccttcaccaaagaagtgggtggggagctcagcgctggggagtgattgccagaggggttctcacagcccgcagttcctcatggcaggcaaggcctttctcatccagccagaggggagagatgtctcctgccagcaccccaggctacacagctgtgtccccagggcgtatcttggtgtcttcagctgtcccagagagatgattacagagccctgctcagggatagctgggtgtcaccctgactgtcatcagagtggactctggcagggccaggctgaggctgaccactgtgtagcttcagctgtgcaaggccacaaggggcaggcattcatggcggggacttcaagcagagaaactcccctgctccttccagttaacttgatcctttcaaaggaaccttggtgcccaaattcactgttgtgttaaagtcgaggtctgcagctagagctgtttaaggagaccacctggtgacctgagggggtcccggacccctggggcaattttaccaacgagcaccaccaagaccccttccaacctggctgccttcacctctgcaggtatctacaggccttgaggccctcacgcttggatttctgtatggttagacattcaaggggcatctttgatgggggaagcgtggcacccctgaccatcagctccatcccagagggacatccctgcaggaagagctagagtgctgcccagccatagctctcctgacactcctgagtcctcagtggagtgagggtaacatttctctccagaacccacccggcctgtagggttcccccctctcccttctccagcccaccgcccaccagccaggcatctgaaactgcatggaattctcctgccttgaaagacccagtggatggatcccggtgctgagctgaggttactcagaaccccagagccctctgagcttctgggtgccttgtttcttacacggtgtatccgatctgacacgcagccagcggagggccttcttaaagagtctctctttgtaagtgacttccagggaaggaccagacatcctctggttccattgatgcaaataataaatgtccgactacaactactcgcttcttacccttctggcaggtttgggctttagtttcagacgcaatggccagcagcttcttattcccatcttactggcaaaggtgtcactccctggaggcacttgaaagggggttgggttggaattgtttaatctcttcaagtcgagccagtggttataaagccagacattattacccactcattaactcccttgttagggctttgcccttgggcagagctcccctgccagccaatccaaagtatgagagtggtgtgacttcatgtacacagttgggtcacctctagaccctggacaatccccttctcccatctgctgagaagggagttcagttggctgtccctgcctgcaggtaggagggtcaaattctgctttgccccttattccgtcttctataaagcctttcccagatgaccccagctcacaatgacccctcccttctctgagccgtggggctcattgtctcgagctgcatcacttgcctctgctatgggaccaaacagcaccctggtcctcatgctgagctctgcagagtaccgggggctagggtcagaccttatgggtcctgaggggataaggtgagagtggggcacaggtggcccagacagcccactccctccagccagatctcactcattagacacccaacctaggttcaaatcccctctcaggcacttactggctgagtgaccctgagaaaattgcttaacctttctggacctcggtttcctcatctgcaaaatggacactataataatagccacctcaggatatgattcagtgaattaatgaagcaatgtgtttagcccaggacctaactagagttagccttcagtatatgtaagctattgttaccaattaagttatttttataggttttaaatattgggtctgtggataaatttcatttggaggagaaaagtttgctactaaaacaaacaaacaaacaaaaaaaaaaaacaagaagaaagaaggtttgaaagccattgaatttcaaccaacccattttgtacatcaccatgtacagtacaaccgagaggcataagaacttttctgttgggatattataccttataatatatcatttctgtcttactggagaaaaagtattttgaggtcaaaaccacactagctccatctcttttttcttttttttctttttctttcttttttttttttcttttttcttttgagacagggtctcaccgtgttgcctaggctgtagtgcagtggtgtgatcatgactcactgcagcctcgacctcttgggttcaaggaatcctcccgcctcagcctcccaagtagccgagactacaggcaagccaccatgtttggctaatttctttttttatttttagtagagataggctgtcactatgtttcccaggctggtctcaaactcttggcctcaagcaatcctcctgccttggcctcccaaagtgctggcattacaggcatgagccactgagtcctgcctggcttcatcttcatcttttaattctacccctgcccagcaccaggctgtgcctgtggtgggtaagggtgggtccttcctaggtggaaacaaaggcagaaccctgcagagtgcacacaggtgggcaactcaggtcccccttctgaccattctgtttctccccatggcccaccctgctggcatctctatctggtccttgctgactcgcaccaggctcaaggtcatatcctggcacaacacattgtatcgtcttgctcacgaacagacaaccagcaccagctccgtgccaggccttgggccctcctggactaagggtgccaagccatcggctctctccttcctgaagcagatttgcccagggcctcgggatttgtgctaatattcagttgctctgaagtagcctggaggtactggttcccaagagactcagctgccagaatttccaagaaagttctccaagtcttagaggcacaagcccccagttgtcgactcccaaatctcaaaggacccttcaggcatctctggagcagctccttcctgtttcagagggtgagacggaggcacaaaatggccaaggtcagaggccgggccagagctcaggctcctggctcttggcctggggctcctcccatgacatcgaggatcttttctgcaaaagttgtgacccgtgctctgtgggttgctcttctgtgtctcctggggcagagtgggaaggcaggtgggagacagcagccactacccaggctgctgttggtaactgggaaatgtgctctgagactgctgtttggtgggaatggcttggcctgcacttgggtaagtggtgtttactgtcacagcagctcgcatccacactgcaggctgccccccaagaagctgaagcctctcaggcctggctcagctgggagaccctgagggcaggggtgagcctgcagagagggctggacctagaaaagaaataaagaaggaaggaagggatttggacattcagaaccgtggggaacagaaaacaagccactgattccattcaccaaggacaggccagctgctgcctcgggcgtcccctccacccccagggattgacacccccgcccagaaaccatccagtggactcttagcaaatcagccccatagggaagaggaggcaaggctttcagatttcagcatccttttgggagagagctgtgtccacaccccatctttctgagtccactcccagcaattttctcaattatctctttaatttattaaaaacccatctcaaagcccagctggtgagtcagcccctgggaacagctggcagagggtgaatggtgggaggaggggagggggtgggtaaggcctgccctgggtggagctgccttccagatgcggccgccactcctgggtaggacacagcaactctctgaaatgtcctttcaaatttaaaatactcaggccagcagcttaacctagaaagataaagaaacaacggtggtgacatttattacgtgcttgctactactgccagatctgggccaaatgccttacctgaagcttttattgatttgctccaagagaaactcctattcctgattgtcttcctgacaagagtgaggctgagcagttaagaccaaggccacagctgcgagtcacagatctgggattcaaacccaagcctgcagctccggggctatagctcccctcccctcctcaccaccctcctccctcctgagccttcctgtccaccttggcctgatccaaaccctttcacacatgaacctcgaggctgggcaggtgttcatcttctcttttgccctcggaggaaagaagcccagcatggccaaggggcgtcaccaagcctgctgggggctcagtgatgagctgggtcacgctgcacagccccttatggttgggagcatttgcacaccttgtcagctctgactacatgcccaggccatggggactgtcattatcaatgttttgcagatgaggaatgaggctcagagaagccaagtgacctccatgaggtcacacagcctgtaagtgacacagtcagaagtctcatcctgaacctaggctcattcaccaccttccagctcagccacctccccaaaccaccagtgtccaggtagccctgagccaggtgcagcctggagggggcagcaggtcacacactggggcacagacgggctgccagatgtaccagcacctggagcgtggctggttcttggcccaacacctgtgggcaaacccggccgcactgctgctggctcctcactgaccacctcccttcccttccttcttccagtcccctgttttcatagcccaagttggccaagacctggtctcccagacggaggagaagctcctacagaagccgtgcaaagaactcttttctgcctgtgcacagtaagtgccgtagtcacctggcctgtcctccccgggctgcccagagatgggatgccgcagctctccacctgaccatacagggcactgaggcaggtcttccatgcctgacagcttcagccaagttataccaactgtttgtatacttcccacgaagagaaaaagatatcaaggtgccaagtccaaagaaaacatctgctgcaaagggtattgaaagcaagtggctctccaggctgttgagacagaggaatgtgcaaacatttgaccctgtctgggtggtttggaagtctttcccagggtcctcaacccccaccactgccaccaacccgagccagtgctactgatgcagggggagcttctcagccaaaccccatcaccttgtctgcaggtggcacgtctgccgtgcaggaggtgacacaagtcgatggccatgctgccagcagagcaccaactaaacccccaccccatcctgcacacacacactctgaaggcatgagcactgaggagcacacacaagtcacttgctgacacacgcaagcacacacacacacacatacacacacacaggctcatgaaagttctccaaagccaggttaccccacatagttggatgatcttaggggctttttgtgtgcccttattcagcaccacagacatcaattgagtacctactgtgtacctggcactgtgctgggtgctgggggataccaaggtgaacaagaacccaatcctggctttcatggagtttttacaagaaaaacagcaacctgcatgcactttgaggggagctgggagggccgtcctgggaccaagcagtgggttaggtgctggagagaggccctggtgggcagagcaagcttggttgctgctctcttggagctgcccaggaatcagatccaacagtgggtggggtcttggttggtgactctgaccctgagggaatggccatcttggctcccaacgatggctttcaggtttggcaggacacagactctgacgtgccccacctgccatagtcccctcccttccccaggctccaagtgcctgtgctagattactcagtgtggccactttctaaaggaaagaagctgcctgcagacagtttcagaacctgccctgatggcctaagacccatagagatccacagcatcccagggctcggcctggcacctggcccacagcaggtgaccagtgaattccaatgcatgcataaaaaaactcccagtggctttgctagtccaagaccagatccagagctgcggttctgaggggctgtggccccacccttcccccaaccacccaccacccctgattcccagcccctcattaagtcttcgtctgttctcagcttaaggtcactttttagagagacccctctacccttccagtccccccaaactcattcatgatgacatacctctgggatcatttatttcatgtttgctattcactgtttgtgtcccacatacaatgccaaccccttgctcccagctatatcccagggcctagaacagtgcccaacacttggcaggtacccaacaagtgttggcaggaccaaccaatttcatacaaccctcagtagaatggcaggacctctggccagacgtgctgcatctgcatgggttgagaggccctgtttacttgcatttccaaagctggacacagctttgcccccctgcttgaagatcgggattataaaatgttcatcctcttgttccatctgcactaggtctgtccacgagtacctgaggggagaaccattccacgaatatctggacagcatgttttttgaccgctttctccagtggaagtggttggaaaggtgagtccaccacaccccatacagatcagggaggcagagggtacacatttttcatctgagaattcatataaaaatcagttacctcccgtgggctcatggttaaaacaaaattaacccgactccccctgttaattaagttgtgtattctagaaatgctgtatgcttattcaagcacacacacatacacacacacacacacacacacacacacaaacacacattcacgcaaatgtaaacagcatctcgttcttactttttttacttcactgtctttgtcagcaaataaagagctgccatattccttggaatagttgcacatccttgatttaatccagtgccctgttgatggatattgagttggttctccatttttctgtgtggagccctccctaaataataaatagctttgtacataaatctttaagtacttctgcaagtacatccagagaaattcctagcagaggaatttctgggtcagaaggcacctgattttaaaccgtgagtgctgttaagctgctgtccaaaacagctgcccctgacctccagtgccacagtgcccgagtgcctgctcctcagcttcatcaatgctgttctcgtcttttcctatcccgtgagtgagcagggcgcttccttgttgcttattttcttgtctctctaataatgggggagaccaagtgtcttttcttgtgtgcttgctgtctaattctcttcaaagtactcgcccatgcgtggctgtgacttgggcagatgtgtccctctgtgacagatgaggaagcagaacataggacctgacttagcttcccagcaagccagcagtgctgccgacgaggccccggccctgagcccccagcgcagtgctctgctaccttcactggcccaggatttgcagagcggggcgatgcctgtgtaaaatccatgccgggccgagctggtagatgagggtgggagcctcccctcccacagcccagagtccctgtccccagaggcctggcatgcacagccatctgggggcatccagtgagaaaggagccatccactgctgcctgccagccccacagctggctgtgtcccccgtagacactcaggaagctgcaggccaggagcccttctgaaccccactcacagcccttccctgcctgcttccagaaatccagcagaaaacccttggctctgcggccatggatgggtggtttctctccacctgactggtggggatgacagcgtgaccagagatagtctccttagtggccgctgtccaccctgcacaggcacatcatgactccaggaaagcttgagaggcaaaggattggcctagacatctactgagggcaccagagcccccagcctgggtccgagtcccgcctctgcctcttcccaaggagggtcctcagaaagggtcactcacgactctacacctcagtgtcctcatttgtaaaatgtggatgattgtgcctgcattgtgggcttgggctgaggaggagataagataagcacaacacctgctggaacaaggcaggtgttccgcaaagctcagccatttggccacaggaagtaaactgctgaatgcagttgttgcatccatcaccaccatcatcaccatcaccaccatcatcagcatcactgcatcaatatcccaccgccatcatcagcatcaccgccatcatcagtatcaccatcatcatcagtataccgccatcaacagcatcaccaccttcatcaacatcaccaccatcatcagcatcatcaccatcatcagcatcaccaccatcatcagtatcattgccatcaacagcatcactgccatcaacagcatcaccaccatcatcagcatcactgctgttatcaatatcccaccaccatcaacagcatcactgccataaacagcatcaccgccatcaacatcaccaccatcaacagcatcacagccatcagcagcatcacagccatcagcagcatcaccaccatcatcaatatcactgccatcatcaccatcatcagcatcaccgccatcatcagcatcactgctatcatcagtatcactgccatcatcagcatcactgctgttatcaatatcccaccgccatcatcagcatcaccgccatcatcagtatcaccgccatcaacagcatcactgccttcatcaacatcaccaccatcatcagcatcatcaccatcatcagcatcaaccaccatcttcagcatcatcgccatcaacagcatcactgccatcaacagcatcactgccttcatcaacatcaccaccatcatcagcatcatcaccatcatcagcatcaccaccatcatcagcatcactgccatcaacagcgtcaccaccatcagcagcatcactgccatcatcagcatcaccgccatcatcagcatcaccaccatcatcagcatcaccgccatcatcagcatcacagccatcagcagcatcaccgccatcatcagtatcaccaccatcctcagtatcaccgccatcatcagcatcaccaccatcatcagcatcatcaccatcatcagcatcactgccatcatcagcatcactgctatcatcagtatcacctccatcatcagcatcactgctgttatcaatatcccagtgccatcaacagcatcaccaccatcattagtatcaccaccatcgtcaacatcactgccatcatcagtattaccaccatcagcggcatcaccaccatcatcagcatcaccaccatcaacagcatcaccaccatcatcagcatcactgccatcatcagcatcactgctgttatcaatatcccactgccatcaacagcattactgctatcatcagtatcatcgccaccgtcagcatcactgccatcatcagcctcactgccatcatcagcctcactgccatcatcagcatcaccgccatcaacagcatcactgccattagtcccacttcaccaggtctgatactgggaggcacagccaactcttgctggaggatcagtcctgattctgccaattacagggcagtctagtggagctgtgttcgccatgcccacgcccggttctggagccctgggctgtgcaacacacaaccccaatctgtgtccaccttcccagagtggcagtgtggggtcaggatacagagcatgggctgcctagaccccaactccagcccaccgctaccagctagggcctcgggcaactcatttcacctcttgaagcctcagcgttctcatctgcagaatggggacaataatgatccctgctccctgagcttgtgtgaggattatagaagcccccatgtgtgcttggagcagtaggtattgttactatagagacccccagaggggggcatgccctttattcctaggagttcaaataatgacatctgacacatcaccagtttacaaagagccctccactggatgtaaggccttctcatgatcattttcctcagaggagttggagcagccttgggccactcagcaagggcctggcaaggctggaacctgaacccagaggccccctcccaagtccttgggccttggtccacccagcactccagttcccatagcagcctttgtcggtggtcactggctttcctttttcttatctgcaccaaacacatgaaatggagaaattatcctttttactctgtggcctgattgcaaagaaggcattaagtttttggagcctgtagggcaggaccctggcctaggaatgccctacatatcagatagcaccctgcacaagatcctgcctggttggtgctgtactgctgaaatagtcaagggtttttttcctcccaaggttaaccaagaaattcctgggagcttgcattccactcatttcccccagcagaggagttctgcggagatgtcaaccaaccgtttctcctccatgcatcgtaaactgttaggcgggccgccttcatgtggtttccgggggcggctgtagggaaggcttcccagggccacgtggtcgaggcaggcgtgtggcagctcttccctttggctgtccagccgctcctgtgcagaagagcgggatacccgcagaggggcagctctgcttcggtggggtttgggccctgtgtcctgaggaagcactggtgaagggagaagtgagccatggcacgcaaattcaagatggggtgccagagagtaccctggcttttcagggccttcctcagagtgcggctgtggtgccacagatgtgatttccagggaagactcattcgttcaagagctgctgggtgactgaaggctccctggtcatcctcagctgacccagttctttggcccagttctgctcgatccaacccctgccctggtcgggacttttgaggaatttaggagcaggagtttagtcttggagagccaagagccaattttcacgttttaagctgattatttgtagccaaacagaccagcaatgcaaaccacaagccctctgcaccgtgatgtcctttatggcaactagataggaccatgtctttgcttagtccaaaaagtgccatcatgcctcatgatcagaagttctgtctgattcaatgtcataaatggctttggctcattaaaacgaggagttggaagacgcgaggtgatcattacttccaatccgatcttggcaggcaggatcttctcatgttcctcatctatgtgggaaatacaataaagggtcctcagtggtggaaaggttgggaaccaatggtaaagatccccaggacacgatttgaagaccagcagcctctgccccctcctgaggccgggtcttctgggccagcagcaggagtgccctcaggaaggaataagccatgcccaggacaggaagcactgtcatcctgctgggcagactgagatgcacaggtgtagggagggctgtgacctccttcgcgtcctttgtgggacgctggtcctctgtggctcctggcccccaccccttcctgcacagaaggcacagcttccttctgagtttcgccgcatgatttgcagagagaggagaaccacatggagagtgtggtcaagcacctctgcactcaggtttttcaagctttctgagcaagcgaggcttgtgcatcccccagcttgcagggggctgggggctgggggccagggggcttgggatttgaacactcagcttcagactaagtcctcgaaggtccagtctccagcgatgattcctggggggtccctggggctgctgtggggctcctggaattataccccaccccagctgctctcaatgtgccactgtttcctgtggattctgagtcttggcaccatgagaccagtgtgggattcttctttcttccaggcaaccggtgaccaaaaacactttcaggcagtatcgagtgctaggaaaagggggcttcggggaggtgagtgaacattcacgtttttaattgaaagttcttacattcaagtcacctttcctgtcccttctaaatcaacctaaagggttggcccacgggtcccccgggggcaccagtggctcaatgtgggccccgggggcagtgagggtgggagagagtcagtggccttggggctatcaggtgtgtctatggtggaaagaggttgtggagctgggcaggtgagacagacgtgctctcctgccagcctcaggcaggatccagcctgcagaggacaaatgggcagccctggtcgtgtgtggggaggagatgtgagggcgtgaggaggctgggcaaccttggccactcagtgcctggatgacgctgtcatgcaagattcgagatttcgttgtacattacccgatcttcccagcatgtgaggcaagccttgttattcccattttagagatgaggaaagctgaggtccagaatggttaggtgacccagccaagggcgcgcagacaatgtgaggcagagctaagacttaagcccaaatgctttggttcccgcttatctggattatgaagtcagtgttcttgaggatctcctatcactgcctcccaaaacaaacttctctaccggcagccggtaggagaaaatcctgttgccctgggaatggaacggtacttggggccccagtcagttatctaagccttggtgtgagtggctcattctgccccttccagggctgggaatccttgaaggagaggaggagggagggcaagggcccaggacagctgtgggccccaggccaggcatcactgggtcctgggagcctggagcactcatgaagccaggcagggccggctctgaccccatccattctctacctgggaggcctgtggtccccgccctggaggagctcggggcaggcctccacggtgctcctgccaccctggtttctttcttgcactgcaggtctgtgcctgccaggttcgggccacgggtaaaatgtatgcctgcaagcgcttggagaagaagaggatcaaaaagaggaaaggggagtccatggccctcaatgagaagcagatcctcgagaaggtcaacagtcagtttgtggtgagtgagcatctgggcccagtgaccggctcgcccttctgtggactggggcttccctccctccggaagggcgtggtcctctaatgcggccggtccccacccctgggaaggggaatgccagtggcagcgctgagctacagaaaggccgcaagacattcctccatcacacggcccattgtggtcgactgtggctggctttgtcccatccccagagccggccagtgcctggctccctgctgtgcatgagaccgacgcctctgttctcctggaccactttgtaaactcctcagtggacaaagaaagttcacctgggcccaggctgggagctgtgggttccacagaccctctaggctggtgccatcgtggtggggaccttagtgccagcatcctggaatggcactatcaagtctgtgtgcattgtgttagtcagtctaggctgggccctgctgcagtaacacatttgccccaaaccctaagtagctaaatacagcagaggttcatctgtcactcacctgaagtccaatcagattgggccaccctcctccatctaacagctgccccatctggagccttgaaagtgagtgctaggggttccacacagagactttccactgcctctactggacagatgttcctcagtttcacccacagtctgccagccagaaccagtcaacacagagacaagttagtttcaggggaggctgggaaatgtgaagtgcatggatatttggtcagctctaatatcttctgctacacactgttataaaaaataaagctgggtgcagtggtacatgcttgtagtcccagctactcagaaggctgaggcaggaggattgcttgaacccaggatttcgaggctgcagtgaactatgatcgtgccactgcaccccagcctgggtgacacagcaagacctcatctctaaaactaaatacatgcatacattaaaaataatatatacacaaggtaaaaatttaaacagcacagaaggatacacaataaaacgaaaagcttccctctttgagtaatcactccaggcatgttttattcatgcacaggctttattattcttagccaatgggatcttcctgtacctcttatggaggaatgtttttcccttacattgtagatctttttctccatccagacctctagtcacacccctttttaaagttgggcatcattctcctgaagagataaagcataatccatatagtcagtccccatggatggaaattgttttccatctttaaaccactacagggccgggcacggtggctcacgcctgtaatctcagcactttgggaggtcgaggcagacagatcacttgagatcaggagttcaagatcaacctggccaacatggcaaaaccccatttctactaaaaatacaaaaattacctgggcatggtggtgggcgcctgtaattccagctacttgggaggctgaggcatgagaatcacttgaacctgggaggcagagattgcagtgagctgagatcatgccactgcactccagcctgggtgacagagtgagactttgttaaaaacaaaacaaaacaaacaaacaaaaccactacagaccagtggcactcccagaggatggaagtttgcatcttgggatctcatcccaggccacccccagctgccagccttgtcgggggtgcaggtgtgggcagtgccatggtatgtggagatgaggcagatgaggctaacttcagccatcatttcagctgcgggccttcttgagtccgaaaccttcctccccactgccagccgcttcagcagggacccctggatgctgcctatggagccttgtctctgaagggacagtgctggcgggttctgctcagggaagaggatcatgtgattcacaaagctgggtggcacgtctttaagggccttcagttacgatggctgcaccttctttaactgtgccccatccacggccccggcagggagttcccacgatgtcacctcctggatccctttctcggtgatcacctgggcagatgtgggagaaaggggacagctgcagccattgcagcagaagcacagtccccatgagcttgctcatccttggctgccattttatctcctttcctcaaaaatagctgatgttgatgcaccagttttacggcacagccagttcccagcctggcccacgatggccgggtttcatgtgtgccacctccctatgtggagaaggattaccttctggtgtaatttgcccctcctgccccaccatggccttgcttcacagagccttgggtgtctggactccaccagcagaggactagaccccctctcttggtggccctttgccaagtggaccagtgtattagtccattttcacactgctgattaagatataactgagactgagcaatttacaaaagaaagaggtttgatggacttatggttccatgtggctggggaggcctcacaatcatggtggaatgtgaaaggcacttcttacatggcggtggcaagagaagaatgagaaccaagtgaaaggggtttccccttataaaaccatcagatctcatgagacttattcactactatgagaacagtataggagaaactgcccacaattcaattatctcccaccgggtccctcccacaacacataggaattatgggagtacaattcaagatgagatttgggtggggacacagcccaaccatatcattctgcccctggcccctcccaaatctcatgacctcacatttcaaaaccaatcatgccttcccaacagtcccccaaaatcttaactcatttcagcattaactcaaaagtccatacatagtccaaagtcccatctgagacaaagcaagtcctttccgcctacgagcccgtaaaatcaaaagcaagttagttacttcctagatacaatgtgggtacaggcattgggtaaatacagctgttccaaatgggtgaaattggccaaaacaaaggggctacaggccccatgcaagtcagaaatccagcagggcagtcaaatcttaaagctctaaaatgatctctttgacctcatgtctcacatccagatcatgccgatgccaagacgtgggttcccacggtcttgggcagctccatccctgtggctttgcagggtaccgtctccctcctggctgctttcatgggctggcattgagtgtctgcaggttttccaggcaaacagtgcaagctgtcagtggatctaccattctggggtctggaggacagtggccctcttctgacagctccaataggcaatgccccagtagggactctgtgtggggtctctgaccccacatttcccttctgcactgccctagcagagggtctccatgagggccccgcccctgcagcaaacttctacctgagcattcaggtgttttcacacatcttctgaaatctaggcggaggttcccaaacctcaattcttgacttctgtgcactcgcaggctcaacaccacatggaagctgccaaggcttggggcttccaccatggctcgagcactgcattggcccctttcagccacggatggagcagctgggactcagggcactgggcaccaagtcccttggctgcacacagcacggggaccctggactcagcccgtgaaaccactttttcctcctaggcccctgggcctgtgatgggaggggctgctgtgaagacctctgacatgccctgtagacattttccccatggtcttggggattaacattcagctccttgttacttatgcaaatttaggcagccagcctgaatttctcctcagaaaatgggattttcttttctattgcattgtcaggctgcaaactttccaaacctttatgctctccttcccttacaaaactgaatgcctttaacagcacctatgtcaccccttgagtgctttgttgcttagaaatttcttctgtgagataccctaaatcatctctctcaagttcaaagtttcaaaaatctctagggcaggggcaaaatgccagcagtttctttgctaaaagataacaagagtcacctttgctccagttcccaacaagttcctcgtttccatctgagaccacctcagcctggactttattatccatatcactttcagcattttgggcaaagccattcaacaagtctctaggaagttccaaactttctcacattttcctatcttctgagcccttcaaactcttccaacctctacctgttaccggttccaaagtcatgtctacctttttgggtatttttttcagcagtgcctcactcttctggtaccaatttactctattagtccgttttcacactgctgataaagacatacctgagactgggcaatttacaaaagaaagaggtttaatggacttacagttccacgtggctggggaggccccacaatcatggcagaaggtgaaaggcacttcttacatggcggtagcaagagaagaatgagaaccaagtgaaatgggcttccccttataaaaccatcaggtctgtgagacatattcactaccacaagagcagtatgggagaaactgcccccatgagtcaattgtctcccactggtccctcccacaacacatgggaattatgggagtacaattcaagatgagatttgggtggggacacagagccaaaccatatcaactaggcacatcctgcatgcaagagaaagcctttaccaggccatgttccacttcccaaagccccactgcccctccagctcacccttacttggccctgtgagaatggctcccatacccaaaagggcaagtgagccctgcttttctgactggccaagaaggcaccctccagtcttccccagctgatgcacacatgtgcttctgtggaggaagcacagacgccattctgttggattcactgggaggtcggggtgctagcctgccctaacccgccttggccttctcaccttgatccactgaaagggaggagcaggtgtgagccccttatcagccaaggaggccgcaggcagggtcaccgcagaggccatctgggtgcaggggagcagggtgaggctcctctgttccctcacaccccagctcccaggatcctgaggagggaagtggaagtgagtggccattgtcacaacctccccatggcactgttcttgtgctcccaggtcaacctggcctatgcctacgagaccaaggatgcactgtgcttggtcctgaccatcatgaatgggggtgacctgaagttccacatctacaacatgggcaaccctggcttcgaggaggagcgggccttgttttatgcggcagagatcctctgcggcttagaagacctccaccgtgagaacaccgtctaccggtgagtggaaggcaccaaggacttccaagtctaagtccgagggggtggggccagcccctccacaccctcgggcaggtggttgccatcgctctgggaatcagccctggtcagcaccaggggaggatgcagagtcagacagactttccactccaggaagctggggcctccggcactgaggaagcgaggtgggccaccctctggccagtgttctccagcctccaaagtttagggaagccaagcaagtgaaatgatgttcctgaaactgactgctccttcaagtcaaggaggacgggccgtgaccactgctccctccagttgcctccatcccagcagccagggaagctgggagggggcctggtggccgctatctgggatcagtcctgggaagacttgggtcgggtcactgcccacaagcagaatcggagtggcccatggtcccactccatgctgtcctcagcttgctctggtcttcaccccctctccccacccacctcaatcccacagggacctggacattgtagggccaggggtccagattccactcacaatgagcagtgcccttcagatttttctcccagtccttctgaaagaattttgaaaaatctctgtgatgctgcattttaagtagacatttgaaatattccatcatattgaaatagtggcaatttttgatatattgaaattgaacagttacattacactcctcaggggatccagtggaatctctagttgctgtagccaattgatttccacctgcatttatccaaaaaatgcacagaaagctctttagtgatgaggaattttctatcatttccttcactctctccatccccccagaatgttaataatatatttttttgcctgaaagtctttcactgattagcgtacatctctgaaacaaatatatagatacatacaagagtttttgaagttctccttgaccgtaagtctctaagtgttaaaataacttctctggccggttgtggtggttcacacctgtaatcccagcactttgggaggctggggcaggcggatcacctgaggtcagtggtttgagatcagcctggccaacgtggtgaaaccctgtctctactaaaaatacaaaaagtagccggatgcggtggcacgcgcctgtagtcccagatacttgggaggctgaggctaaagaatcgctttaacctggaggttgcagtgagtcaagatcaccactgcactccagcctgggcaacagagtgagactccgtctcaaaataaaataaaataacttcttctgtcgagttgccattgtaattagtagtagatctcatttctaatcagtcctttggaagcaggggttttgacatctggagtgggtcgctacagtcatactcgggaggggaggaggctgcttttcttctgtaacttgggagaagagttattgagaaagggcagatgggagggagatcccaaaagatgccaggacagagcatcctgatgtgaagaaatccaaacccttcaaactgcggacaggagggaaccccctgctcggtcctggcagaccccgacacgcagcccagtttgaagacctttgcagtggagctcatcttgggaccaagaaggttttgaaaacaagaaagaatggtcttgatgacatgcccttccccccataccatccccccatttatgtttctgttttgttttcattcaaatgaaaagagtcaaaattttccctaagggttgaacaaagaattctctacgtgattgccttttatttaaaaagaaaaaagaaagccctccaagttccagctcgtcttcttccgggggaaagagaaccacagtgcctcctccctggctgtgaccactcaccacggcctctctttgggctccgttctggccagtgcccactagtgagctgccatgctagcctggtggcagccggcttgttgagatgatggctgctgcccttatttggaattgttaacacatcaaaagaatgccatttaaataacagcaacaaaagtattttatgataaataaggatacacaaacaccaattatcatttgatgaggctcactggctggatttgggtacattaaccactccgcatgaggacagctgccatcagttaaataaacaaagctgggtggttgagaactggagcctccatccagatcctgtgtactgtttgccccatggcttaactgagttgcacacactctcctcttggctgttcttttacccatagagaagaccttttcctataaaagcagctcctctgctggctctcccctcatcctgggaatgcagaggctcccttacttgtgagcaagatcctgtcatcaagagaggagacattagggacaggataaggcagccacacctatgccatgccccgtagctgttctttctcccaggctgtagcgtagctggtgttgggggatatgccagtctcctgcaggccccatcccaaagggggtctttttcctgtgtccccaccttctcccctttgatcctctcttcccaattgcacagctcccttcattccaggccctgttctgccttcagggcttcctgagacctgcagggtcttctcagccttggagtatcctcagacctgcagtcattgatgtgtgaacaggggccatgactggccttttcctaactttcccagtcaccctccaggattgggaaatgcctgtggcaaacggcagtgttgctttaaattactggaaggagaaaaattagctgaagatcattttgactcaaaccagacagcctgagccaggaggtgggaaggaaacacactgtggccactcaggcctgattagcccgaggggtcgacccagatgccagtgtatcctacctgcccagaatgcccacactctgatgcttgttgtttttcctttcagagatctgaaacctgaaaacatcctgttagatgattatggtaagtcttttcctactcggtagctgaggtgagcattgcaaccccaagaaagcaaagggcctcccagggattctcagagagggctggggaagctgaccacgggccccactcccactgctcagtgctgggtacctggggaagggggaaagctgtgagtgtgaacagagctccgcttggtgaacaggcagtgttcagagagactttgaaattcagagtttttgaaattccctttgaccataaggctctaagtgttaaaataacttctggccgggcgtggtctctacagtgcactgaacaaggagtccagaatttcagagatgctgggcaaatacttaacttccatcaagttctccacctctcatcttgtttgtaaaatggaaacaaagcgtcctgccctgccctgcccacccagaaggaagagggtggtggagaggcttctacatgacagcttgagagggaattgcttgtcagtctagccagctgtaaatgtctcaggcattacgtttgtgcattaccatcattattttctcttggctgtggacactgaataataagaacaaccacagtacccctcacagctgtttagcctcacacctggaaaatagttcctataccttctttttttttttttgagacagagtctcacttgctcaggctagagtgcaatggcgtgatctcggcctactgcaacctctgcctcccaggttcaagtgattctcctgcctcagcctcccaagtagctgggattacaggtgcacgccaccacacctggctagtttttgtatttttttttttttttgagatgtagttttactcttgttgcccaggctggagtgcagtggtgcaatctcaactcagtgcaacctctacctcccaagttcaagtgattctgctgcctcagcctcccaagtagctgagattacaggcacgtgccaccacgcccggctaatttttgtatctttggtagaaatggggttttgccatgttgaccaggctggtctcagactcctgacctcaagtgatctgccctccttggcctccctatgtgctgggattacaggcatgagccaccggtttccacacctttgatctgactagatcttcccacctgcacagagaagggcaaggcagcatctctgtgcccatttaacagatgacaaaactgagcctcaggggagccatcctgccaaagtcacccagcagcatcagtggggagctgagggcagaaactgggtctcctcccaccaggccccagaacctggcagcccccagtagagggaggggagaaaccgggtcgctgatgacctgaagagaggtctgcatgggatactgccctgtggaggggcggtcggagggcccaggcctgccgcccctctctggatgtgcccggtgcctcccttggtctaagaaccaagcccacgctgctcctctgctatcctgactgtcagcccccaccgagccagggagtccacacggctccagcctggcggggtctcgacactggcccttgctgacatctaggctggagggatgggggtggggccctggtgtccataggcagggaagggaaggggacgtgttccttcctgtggggtaagttgtggccgcgaccctgcccaggtgggctgtgggagggacaaagaccaaagtggagcctcagctcagcgtctcccgctctgggggctcagtcctgggctgtgagctgggattcatctccaggctctgccaggtcagaccagatgttttcccttctcgtttctctaaagtgaaaaacaaccaatctccagagaccaacaaggcaggccggggagctgcttcccaaatcgttttataattttttccccttaagcaaattgttgcataatgccagaagaacctcacatttttcccatgaagtaatcccagaaccaagccaagattctctgacctcagcgttccaggaagcccattcagcctttgactaggcaggtcggtcaacgtccagccgggtccaggcatcctattgcatctttatgttccactcctgaagagtgggcattttcctgtgtcctcccacacctgcactctcccaaggctcttgtggtcactctgagatggcagattggggtccctgttgtccttggacagatgagaatgccgagagctcgtatgccttgcccaagggcacacagcaaggccgggtgcccatgcggctgtcccagggacccactgaccctgctgtccccctcaggccacattaggatctcagacctgggcttggctgtgaagatccccgagggagacctgatccgcggccgggtgggcactgttggctacatgggtgagtgctgggctgcctgtgtcaatgcaccttgagacccaccacctgctcaccgccggccgagcccccagagcctgcccgcagagcctctcgcctcttcatgcactgctgatcacacacagagtcacagtctctgcagggctgctggggggcggccttagccagggggagggggagcacaggggccccagatgtgatgactgctctgagctctctgcactcccaggcccccagccccacctgtgtccaaagccaagccactcttaggggtcggggcctggcatacagcgctgctaggggaggccacattgaagcaggggtctgggaggagaggcctttgagaggaaggaggtaattcacaagagcccgcaaatgagaggcgcgcacagctgctgtgtcaccaagcatgattccagtagagagcagccttgggctcctgccacctttcctcagtctgctctgagaccagcgtcctgggggttgcagggaagagacccagagttaagtcctgtgccctagaatcccccgtccaattgggggcacgccctgggcttcctcctgtgcatttcacacacctaccctccttcccctgagaggcgcgtgcccggggagcaggcacgctgccgccctctagtcaggctggtactgacagcagctgcacaggaggtgtgccttgtctctggtgctagagggtccttttcagattgcatgacatttggcaacctgtggagtgtgtgtctgtgtgtatgtgagtgtgtgtgtgcccacatgaatgctgatcgatgattgataggtaggcgggtgggcgggtggatggatggttggatggatgatggatgatggatgggtggatgatagatctgcctacctgtgtgtgcatttgcctgggtctccttttgcagagtgttccatgcatctgtctgccccggctcttgtgtgcaaaccagcacatgtgtggatgcatttccctccagacatacgtgctgatgctgcagaactatcttttctgtatttctatggtaaatctgtaattcggtttatcaaagtggtacagaagacatagcaagagattgtttgaattacagataaatttaagatcatctttaatttgggtagatacacctttattcattgaaacaaatatactgatagcacctgttctgtgccaggtgtcatattgttacggtagtgaataaagtagctcatgttctaggcgaggggacatcaagagtgcaggacacctccatccacggtggtcagagttctaaagctacagtcaaagtccttcgggggcacagaggagagtcatcagggcaagctccctggagggggtggtattcacagcagttggtggggtaagagttggtggcggccatgaaactccaggccttctgtgagcagcgccaccagctgtctccctcctcctcactcctctctcctctcctctgcccccagctccagaggtcctgaacaaccagaggtacggcctgagccccgactactggggccttggctgcctcatctatgagatgatcgagggccagtcgccgttccgcggccgcaaggagaaggtgaagcgggaggaggtggaccgccgggtcctggagacggaggaggtgtactcccacaagttctccgaggaggccaagtccatctgcaagatggtgagctcctggtggccagatgccaccctcaagctggtggctcccctccctgggcctggccccagtctgtccccagaacagcaaacaggctgaagggacaggggtctgagcatgggggtgggggttgcagcccaccaagctagagttgagggcactccttgctgtggactggggtggtcagcggagacttccaggagaaagcctgggtggggcagggacacccaggaaccaagggaagaggggtgaggggaacagtgtggaacaccctcacatccagcctgtgggggggtccacacagggcggagaagagatggtctgagctggtgccccagacacaaagcaaccttgggccaagccccggcccctgcccgtgggcctcctgctccctccacctctggatcctaaggtgttggtttaagacgaagggctacagggggtgggggcgacgatttcagtctttgaacatcttataacaaagttttccaccactagatggactgctggtcacgccagcctggctcctgcatgacagggtctagggatagtgaggtcagacccacccaaaagctgggtgggtggggccagatggggggactggaagccagataaggagtgacaggagccattggaagtgggggatatgggagtggagtccgcccgtgcacccctgccactgggccgccccatgccggccctcaggcccttccctgggaaccaggactagtggctggctttgtggggagatggccacttcctgctgctgcctggctctcagcccccaagtccagcccatgcccccttggggccctcctccttatggtccccagcacagctgtgctggcacccccactgcaagcagctgccctctaatgccagcctcatagggacaggaggggccggagcacccagctccacaattgccagcccacagacttcctctcctctccctggagccacagatgtaccccgtatcccatgtacccggagccacagatgggcaaaccgagcctgggaggggggagccacacttcccacccctctacatctgcaggcacttttggggcagattcagcgtgtgcattgacaacccaggcaactcccggagtttaggaagcagcagtcctgggagttgattaaaagtcgcaatgcttctgctcaggaagacctgagatctgcgccgcaagcggccccaggagggtctggctcggctcctcaccccagaggcccctctcctgcagccagacacctctgcttggccccttcctgtcaccaacctcatcctcacatcacagagctgtgggaagaagtcctgtgtgtacagcagacccacactctaaccccacagctgttggcccgccatgcagctggggcctcagagaaagccacatggtcatcgcagccagggctagggtggggggaccggaggagcagtgcagcactggtcgggtaaatggaaatgtgggtgtgagccatacttggctgtctcattgggagatatctgtcaggtgcgacaaaacgagacaagggaaagaagaaggggtcagacagccgtgggcagagcatcaccaaatgtcccaggtcagggccaggcaatcagagaagcaggtcttgagagatctcagcagggatatgggacgtactaagaggatgacgaggcggagagggccccagtcccacccccagaccccagacacccaccttggcccctggctttggagctgggatctcctgctgcagcctggaccagggtgctgctgtccctctgctgccccctggtggacactgagagaaagcctgctgctcccggaggacctgtcccgtgggtacaaaaccactgtcctctggaagcctctggccttgctgcggcttcccttacaaatgatctttggtcttgggagtctagtcttaggcctccttcacgcccttgactgcagcatctccggcatctaggcctaccttgtcccctccagctggtggcagctcaggacactgcagagcctgacttgccaggagacctcgcaggtcctgggttcacagggctatttctaggctctggtggctccagccctgcctgcctaagagggtccctccacaatcagtgaggaagccagtctctggcccccaggtctgtcccccattctaccttagcagccgcagaacccactccccctcctctggagcccagaaattcacacatctcaccactttgtctcctgagcccagtccatgggcccagacctcagcctccatcttccccaaacccctgctcagtcccagcactgggccttagcccccctccagctccctcttgcctttcagccgtcttggtctcacttgtccttccagcccatctgtacccctcctccaggaagcccgctctgcctgccccacccatcccagctcacaccttctcttcctctcacttctcctggtgtccacctgatagcatgattgcaaactctttacctgacgatgtggctgcaaactgttgactggatgccagggtttcaaatggcagcatataggcgggtgttcaacctgcacacggtttttcaaaagaagtaaatggtaggttcattgccaagatttagaaatgaggagatttcatgtaataacctggattttctggcttctcttgaaaagcagaagccccaggccctggctgccgtcccacctggcaggagctgacacatagcccggcccggcccacccagcccacccctcgcctttctcatcctcgtttgtgccaccttcctggccagctgctgcagcccctgcagaaggagacttgcctctgagggactgcttagaacagtgcagcacctgggcccagcccaacccagtgccttgagcctttgttgaacagtgaagcccccagagagagaagcagaggcatgagtgccagaccctgagccgccagcctggtggtccgtgggggcgttaaggggcaacactgagcgactgagtgctctgctttgtcctttcaagggtggaacctggtgctggccctgatgccaccttcgattcctttgtttggggggcagccccctccagaccctgagccccaagaggccagtctggctgctcactctccccggcgtccccagccggtgcagtgcctgccccacaaggaccagcaggaagtgtacatgggatgaatatgagcaaagcgcacagggcattgggaaaagacaaggctgggcccctaccccaagcagtctgctcctctggattttagcctcaaagcagacacttagtagacaccaactgcgtacagctgcagcgctcagtaaggcagaggagaagagagaatcacgaggctggggcactgggagtgcaggtcaggggccggggccctgtggtcgtgtggctggccatggctagtcaaggccccctgcgcaggtctagccctctggcctcattcatagcctcatcccgtctcacctgggtgtctgctcccaaagactcttcctctcctagtaaccttcctgcctcgtggttctgatgaagacactctcctacctcaaccatccctggctccttctacctccagatgaaaatcccgccacctgacctggccttcaggatcctctatcatctctccctgaccagccccctccccttgacccatctctgcaccctcctcccgctttctaagtcaaacgtgttttgggtgttccccagactcaccctgcacgtcctgccactctgctttgctggtgcagttccctctacctgtatacccctccccctacccacaccttgaaagcctatttgtcctgcaagactcaacttaaatacctcttccccgtgcagctccctgacctccagctggcagccagtcatgccccctgcccccggggtgcccgatctgtatcaccttgatgcgtcctctgagcatgattagccccccatgagtctgagcactcctagaggccaagtgcctcggtggtgccttctctgtcaggaaggggcttgcacccaggaggtacaactctgcaaattagctgagtatgtgcacgagacagagctattgatgcagtccttgccttttgttgcttaccctacacagaagaggtgacagtgactcgacacccattaatgagtgcccaccataacccaggaacgaggtctgtaatcctgagagaaacaagattcctgctctcctgtcccatcaggcatctagccaggctgtgagtgtgtgagcacagatgcacgccaagactcagaggcagccctgaagcaagacctttgcagggtggggcagcgtgtcttgggttcctaggcatggtgcagacactgtggaggcaggaggtccggacaggaggagaggcccaggggacgtggcttcatggggctctctgtttcagctgctcacgaaagatgcgaagcagaggctgggctgccaggaggagggggctgcagaggtcaagagacaccccttcttcaggaacatgaacttcaagcgcttagaagccgggatgttggaccctcccttcgttccagacgtgagtagcctcccccagcccccagcagctcccttcacagggtacccagggctgcccccgagtgctgcctcacagtgagctggtgcagagtgtggggcacatcgtgtctttgtggggaccagggtcccctcccggccactcctcacctaagctgcagatgaacttcacgccaggcagtgcagaagaggcgtgggccagggagcccacattggctgtccagagacttgggcactttcccaggtctgggggtcctggacagattccttctaagcgtcagtttcctccctgtccagtgaaaccagtaacactcatgcctcccacctgcctgggagatttgagggtgaaatgagaactgaatggggaatgctttcaagagcattgacggccactacattcagttcatcttgaccagcatgcatgcatcgagcactactgttgacgccaggttctgggccaggcagaaacataagaggcccctcccccagcagctcacattgcagggagttgcatcttcccaggaggtccccaggtcccccagtcggtgtgtgaggcaagattccagctgaggtagaattgtccttgaaagtcccctacatggtctataaatcatgagctctcagctggatcagaggcccaagagatgcagaccaggcagaggctgggtgatctgtgcgggatacgtgctgtgattccggggcctgctctgtttaaagtcagggagtcagaagccaggaaggcctgctgtgcttcggctcctgccacgctcccgcggatgaccccttgctggcagggggactgggccggggactatggaggccgtgggagcagcagtgtgctgcaggcgaatgactgcatctccagagagctcatgtgcacctctcttcccaattccgtgtccaatggctttgcgtcggtagcttacagtagatctggtggtagcatctgcacagcagcaatttgcaaatgctacaaatcagggcctctgcgtccccctctcccagaaccagtggttatcacttaccagtaccgccctgagtggaggcaggtggggaccgtccttggaactctggcaccccctatacatggggattccctggtcctctgggacagaaggtggcttgggaagctgctaggtgcggatcagtgtccatggcaaccacaccacagaccccgtctggccagggatggcatcagtgtgatgggtaatcagggaatgctttttggagaaacacgggggccactgagaatataaagagtaggccgggcacggtggctcatgcctataatcccagcacttgggaaggctgaggcagtcgggttaggagttcgagaccagcctgaccaacgtggtgaaaccccatctctactaaaatacaaaattaaccaggcttgggggcacacacctataatcccagctacctgggaggctgaggcaggagaatcacttgaacccaggaggcagaggttgcagtgagctgagattgtaccactgcactccagcctgggcgacggagcgagactgcatctcaaaaaataaaaagtgaaagtcactgaatgctgcaaactcaatctgcagatgagcttgagcaggcagggggaggatggtaatcacagcattgctctcgaccctggctgcctggcgaaccgcctggggagcatgaacaacactcgccttggatgcagtccccagggagtctggggtaagactcgggcttcaggagttttgaaacctccccagctgattctagcgtagagccagggttgagagtcactattatgggaagtgccacatgcaaggagtgtgttgtttgttgtttgtttttagtgccaagggctttgggagtggccactccttggtgttccaggaaaccacatagtgttgagtgcatgaacatcacggttgtgccattgggctgatgtccgaaattggagaggatgtgggcatccagactgggggtgtggcaaaggtttggaacccgggtggccatccttgtggcctctgggctacctattgctatggtgacgggctgagattagtcatcgcattggagctattcctctaccttccagcacactccaggtcccgtgccaggccccaagggagatcccatggcacacaaaacagttggttgtttccagtctgaagaggagcaggggtgtcagcaaaaccccttaaatagaagtagaaatacgagtcacaagagaagagaacaggcagcctccgggaagatgggagagtagcggggcctccgtgcgtgcacccaggcatggctggagaaaagcgctccaggccctggaagcagcatgtggaaggaggcggctctgagggtcagagcgaccaactgtcctgctttgcctgggactgtcctgcttttagcactgaaagtcctgtgtcctggggagacagggacagttggtcaccctgggagtgaccctggccacttcgaatcagggcattaggaggatgaggtagcagagccccgcaaagcgcacagcctgacaaggtgcacagagcagcccaccggtgccctcctgcctcagccgtgtaccctgtggcccagggcctctgttcctggcatccgaggcctcaggtcagcaaaggttgcaggccctggagtgcgaagccgctgtgagctggggactttgccttttccccactggccctccccaggctgcacgccaacccccagtcatccctgccagccccccacagtcatcccgccccccacagtcttccctgccagccccccacagtcttccctgccagcccccccagtcgtccctgccagccccccacagtcatccctgccagccccccaccatcgtccctgccagccccccaccgtcgtccctgccagccccccacagtcatccatgccagccccccacagtcatcccatccccacaccactgtcggggctgctgccacattcctaaaccacgagcactgtgagtgacatcatctttttcacttccattgactctttttttaaaataaaaatcaatgtattttaaaaggaaacctttccaaggaaataatagccatgaaagaggggtttgggtgtgccaggtaactttctgttccattacagatttttaaaatacgctcatttcttaacattcctctgcaagccacccagggccagcttcgtgagcttgacctggcaccccctagggcaccctgggtccccacacctggctcagtgccctctgttgccatcttaaaattctaaatgtggaacatggaccctgcgttttcattctgcgctgagcatgtgaatgatgtggtcttgcttccagctaaaagtccgctgagttccacggtggcgtgcaccccgggctttgggaactagagaagggtcgcagctctgcaactggacacccctgcccgcacccctgcttccgtccacgtgcacttgggcccatggtttgctttgctggggacagcatggccttgagccttgagctggagaccagagcagactggaggggagagtcccagaaagtgccgagccctgagaccattgctagaaccttcctggcatggcggagcccatgctgagccggtgcactgattcacaaccttcgtattagccaaatgtcaggagactataagcaggaggtagcctctaccctccagtgacagatgtgtcaccaggtctggggatcccttcacaccccacctggggctgtctctataaaggcctcatctccagaggctctgggaagcctccccacaccaaccttgaactcttagagggcagggtccacccaggttcatctctgccctggcatagagcaggcccccagtgcacagctgagggacgagtaaggcaaaagatatgcctaccataataataccagctcccagttacgggcgccaggctcggtggccagcactgacagcagccccatcgcccaggtgcctcgttgtccccattttgccggtaaggaaacaggacataggcctcaggggatatgagacttccccaaagttcctaagccccacagctgggactctagcccacgtctgtccagtatgggtaagggagtgatggcaggaatgagccctgggctgggcacccaggtgccccgagctcctgtgtcaccccagccagggtccccgtcatggatctgagagagggctgcactgtcatctggaggggtcgcacaaaaaaaccacaggccatcatctgaggtggacaggaagcccagccaagccactggggccgacccctcccctggactcacctgcatctgagccacacaccctccagccactacccatagcagttctgggggtgtgtcctgggaagactcccttctgctccccaaaaccccaaggcctggctcggggccactggagccgcaggcgggacatatgtgtgaccggccctctgcccctggcagccccgcgctgtgtactgtaaggacgtgctggacatcgagcagttctccactgtgaagggcgtcaatctggaccacacagacgacgacttctactccaagttctccacgggctctgtgtccatcccatggcaaaacgaggtgagcagggcagaccacttgctttggtctgggtgggagggagggactgacgggtggaaggaggcgtcgggaatatgagtttggcggcaggaggctgagcgcatggtttctgttttctccatgaaggcagcacacaaaagctgtcagtggccaagtagggagctgtagccaccacgggccagtcattgacggggagcctcgcccagcccctgagacctggagggcgtgtggctcaggggcaggtgaggccaggggagggagccccagtggctttgctgctgggcttcctgactgccccagttgacggcctgtgttttgttttcacggcccctccagatgatagaaacagaatgctttaaggagctgaacgtgtttggacctaatggtaccctcccgccagatctgaacagaaaccaccctccggaaccgcccaagaaagggctgctccagagactcttcaagcggcaggtgagacacccatgcctggccagtcctggcatcagctccgagacccctggctcacttccatgggaaacgagaagacccacagtagagacccttggaaggcttggaagtctggggcagtagcagcttggaagggcaactgattatgtccaaggcccctgatacccacggcagctgatgggatccccggggagaagggcagggccagcccaaattcaccctccctctgggtttctccgccttgacactgttggcgcctggggccggttaattccttgtcacagtgccgtcctgtgcatcgcaagatgtggggcagcaagtttggcctccacccaccagatgcagcaacacgccatcccccagtcgtgagagcccataaaggagccagacattgctgaatgtcctcaggggcacagtcacccctgattgagagccactgccctctctggcccttacgaagcctcagtcatataaagactgaacatcataagcccagggagaactgggggtagaagctgaccccacagaaccttccggctcctgggatggcccccatccaatgctgtgccctctagctggcagccagaggagacagggcccttgggaaatgacacttagagcctggccctgggtaagggttggtgtgggccaatggaggaaatgcgggggaagggcccccacctcaccccacaccatgaaggtggccaccatacaccccgtcttggcctggcccctgaggaagctgtggcccagtgtgcccgccctggagcctgggaggctccctcacctagttctgctccttcctcctctccacaaagagccagctccaggatggacacactcagccagtgataatataaaaatacaacgcttcaatgcttccatcaagtaaaacggaagttccagaaagaatgacctctccctcccctgatggccaggcatgctaagaacaccctgggtcctagaaaaagaaattaccatggagtctcacagacccgggttcaaacccagccctgagacttcttggttatgtggcaacttacggaacctctcccacctcagtttgcctgcctgaaacatcaggatagaaatgcccattgcctagagccacgggtggcggcccacatatgggcaccagcacctgtgaagcaaacgcttcttgcctccctcctcctcccctctgcaacatgaagggcccagcactcacgggatgcagagggaaggcctgagcaatgggaacgaccgcccatctctcccaggccggccctcgctagagccctttgcatatgaggccccattgtatcctcccagccaccctgtgcggaagctgctcttctcccgtgttacaggagaggaaactgggagatggaattgcatgcccaaggccactctgcgagggaggggaagactgagaattccagcccaggcagcgtaaccccatgcctgcaggcttaaccaaggtggatattataggaggggccgcctccaccctgattggaggttctgttaattccatagctcttcccaggtacctgtgcctccaggggtggcccttgtacctggctctgaggggagactgcaaaaggcaataaaaagcaagggttggagcaggcagaggcagccccgacccatccccagggctcccaggactgacttctgttctctccaccccgtctcccccaaccccaaccccagcatcagaacaattccaagagttcgcccagctccaagaccagttttaaccaccacataaactcaaaccatgtcagctcgaactccaccggaagcagctagtttcggctctggcctccaagtccacagtggaaccagcccagacccttctccttagaagtggaagtagtggagcccctgctctggtggggctgccaggggagaccccgggagccggggaaggaggccgtccatcccgtcgacgtagaacctcgaggtttctcaaagaaatttccactcaggtctgttttccgaggcggccccggccggggtggattggatttgtctttggtgaacattgcaatagaaatccaattggatacgacaacttgcacgtattttaatagcgtcataactagaactgaattttgtctttatgatttttaaagaaaagttttgtaaatttctctactgtctcagtttacattttgtatatttgtatttaaatgaaagtgagactttgagggtgtatattttctgtgcagccactgttaagccatgtgttccaaggcattttagcggggagggggttatcaaaaaaaaaaaaatgtgactcaagacttccagagcctcaaatgagaaaatgtctttattaaatgtagaaagtgatccatacttcacctttgaaggattggttgtatttacccacatctatctctggagccatttcctcacattggtgtcacccttctgtcggcttggaacaatctgaattaaatgttccagacacacgtgggacttccccctcccagccagaatgtcctctcctggggccctcggagtcgcctaggctgagcccttctcctcgaggggcacgccgagccactgtcgcacccacctctgtctgctcttccttcaggaaggcggctggcacgcggatctaggtgtttgcagcctggtgggcgatgggcctctttccttctaagcaggtcctgactgctaaagccagtcatttgcaagaggtttgcattgggggatttttgctctatttttaacagaagcataggaccgtaaagatgtgtcatgaaaccccaagtgtcccaaagcctcggggcccacaggagcatcgggaagtgaggcagtgcgctcatcctgacggagcagcgtcgtgtctgtagcggggagggaggctggcccaggggcccggcatgttcctgaagcgttcacagggttttgagaccttcacagccccatcaatgtgctggcccatgtggcatggatggggtagtctctctgggcaaatgagaggcccaaggagagaccaagccaccaaagggctcaagacaaagtcactgttccttccccaggaaggtggggcagaggcaagatctatcggacatttcaaagtttcaggcaggagctcctagaggacttggtggctttgccagcccaggggcctctgaaggcagcccccagacccttgtagcagggctgtccatccccagggagcagctggccacctcctcctgcctcgaagaagtgaccaggggccaatctgctcccacctcccgtccaggacagggtgaacatttgacctcactgtcccctgcccggctgagtccctgatgtctgactgtgccacccagcagctgccagggtctctcaccatgtggaccctgccctagctgcagctgcacctcctgtcaaaagtgcagactcgcaggttccaccccaaaccacagaatgggaatgcctgggagcccacccctgctgtgggctctcagcggggctttgggggtgatcatcccaaacacatttctctggatgacgcaggcagcattggagcatgagccgtggggaggacagtcgtgagcacaccagctgtgaggcccggtttccatgcctaacccccggactctacccctgggtcctggggcgtaccgctaaaagggtcctggcctttgggactgatcattttgaggcccttttacaaagaaatgggggagaagaaatagctgggcttccctcaaatctttttaatgtgcagtatttttttgttcaagaccagctcttgttttatgaggctccttccattacctttcttgggctgaatgcaaaacaaatacagccacattcaagtcttccaaggaagtagaaaactctttgaatggtatcttaagatccttaagctcttgctgaacttcctttttcaatgaaaagaaggaccatcatcctaggatggtcaccagcccaagccaccaccccagccacccatccaggaggttggttccttttgcccagttcatagcagctcagtccttaccagatggattcttggtgttgggaagcagcctctttttattcctgaaaggcaatgccctgtccgtttgcagtagagaatccccagggagcaagaaagatgacagaagtgtggctgccgtgtttctaggtcatgagagctctggcgatactaccacaaggcctgcacgtggactctatgataacttgagtcttccatcatgtttgccaccagccctccctgagtgcccagaggagatgggggcagagtcacttggcctactaaagcctcctgttccttctggctcatgcattgctttgtggtaagagaaaggaagtctttagaacagcgcctgggaatcagcccttctccctactgagtccccagtcctgtcccttccctgactcgctcctcctccaaccttggtttctatagctgcatttttttttttttttttttttgagacaagatctcattgtgttccccaggctgaagtgcagtggcatgattctggctcactgcagcctcaaactcctgagtccaagctatcctcctgcctcagcctccgaggtagctgggaccataggcgtgcaccaccatactcagctaatttttaaaattttttgtagagatggggggggggtctccccatgttgcccaggctggcctcgaattcctgagcccaagctatcctcctgcctcagcctcccaaagtgctgaggttataggtgtgagccactgtccctggcctatacggtcattttttaaaagatattttaaaattaaaagcaaacaacactgtccacccatctacctgtccaggataaggcatatttggacggtgaacggatttactctcgttcatgcatttgagcgcttcacagaagagtctttcttgctccaggcatgacattttttttcaccagacgttcactgacttcgtgactttgaggtgagacatgggatctctcagaagcgtctctgcatctgcatttcaggagatgagctgctgtccctggtggacagaggcggtctctgccatggtcaccatgatgccctacaagtgtttattgagtcccctggggggcacccagaataccacccaaaatagcaagaagacccggtccccgccttgcggacgatgcactcacatgccacagcaacccattctcgcctcttccttggccgggaacccggggctctagggctgctcgctgctgctgtggcctgcgcagccacgggaggcttcctgaaaggcattgctcggaggggcgggggcggggaggcctagcctgccccacagacacagctgtgaggcctgggtcatacacataccagcaagcagctgccgagacaaatggtggtgggaagtcctgggaacacacacagcctttgcattgacagcacaagtaggatcagagcccaggtgagcccctgaggataccgaggccttccctccctgaggcccgcaagtctccatgcgtctcccgggagcctggccccgctgcagaaatcccttctcttcctccacaccctgtcctttccccaaaggctcgtgttatcagttccagctacccatcgactttcccaccgagccgctgccctcaaaacggagggggcaccgcagcctccttgagcctggcatcccaggccttgccaaaggggacggtggcttcctggataattggaaatctctgagaagaagaggaaacacctgagtgacactcagctgtcctctggggtcccctggtgtgcatgcacgtcctcctgaatacctgtacttccaagaggtggtctcctgttttcataacccaacactctgagataggatcttccaactttttagccccggctgtggaaagatagtgagtatgaagtctttgtgcatttggaagtgacatcgctgtgtggattatgaatacagagagctgccatcttcctgatcacaatagaccacgattgcaaagcctcctctcccagagaccccttctgcgcctgccctccccacccaccacccagctgttgaagctcagcgtgtgcaagtcagaccctgcacaggccgggggtgtctcacctggcctaaacgtaaaggcttgtgccggagacagtgattgaaaacatttgaaaagccagctctccctggcagagaaagacacttcccccccaaagtggaatttagatgtctttccctagtccatcaagaagtcatttttgtaacagtccctaagcgagtgttctcaattagaagagtttagtggcttttggtgttgttaaaataataagaatccttctagcatccaaagctttctaatttttttcagggagatttggacattaatgaatggaaacttccacagtggcggtcactcctgaaggcagcggcttctgttctcccgctgctgtaactctgtgtgttccgtctatcgcgtcacagtgccgctggatctagatggagccactgttgttgtttttaaaagagaaataaattccttaatggaagtagcatggcatcggcatctctctcctgctgctgagctcttgttctgtttcttctgcatacgacagctgtccccaagatgcctgtggcctttgggctaaccctttcctaaggttgacagtggaacccacccaaacccggcccccacactgaccaccccctgaactgcccacagatggcccagctccagtgggcggggcccaagaaaacctgaattcttaccaggccgccggcttctgatctcaaacccagcagatggttctagaagtgctctggccacttggcaccaaggaggagctgggtgacaagggctcgagccagtgccagcaccatgacaccaaacggcgcatttgcaggtcccacctgcccggtcttatacagaagaggcgggctctgcagagggagcctttctggctgtccaggcttcgccatgccaggcacatgctggaacgtggggtagccagtgaggcacagcggcccttgcacctcagaactgggattcccgatctgggacccaagacctcttctgtctccctcgacctgcttgccttagctgttagaatgagcagggcttactctgagatgtttgttttaaaaataaaggtaaaaataaattttaaaaataaataaataaatagaatgagcagggctgggactcagccaacaccctattgatgatatatgaccttaaacaggccactctgagcctcggtgtcttcatctgtaaatgagatcacacctcagtgatgtggctgctggaggattcagtgggaactcatgggccacccagcacagaggccttggctttgagcaggggcctggccttgacctcacacccattcacacccagccctgcctggagccacactccagccaggcctggagcctggggaagaatctgcttactgggggaccctgtggaattggacagagagaaagaggggccggctggcaatgagggtgggatgaggaaggggctctcccaggatggaagaatgggggtactcatggccgaggatttgccgaccaggcgggtagccctcaagggcagaagatgcaggggtggggcaggaaatgctctgatctcagaacagggatggggaggacctccccgcagggcccagctctgtctctggggctttcaccactccagaaactccactgtccgagccagcctccaggcagacagaagctgccgtctctcctgggacaggtagggtatcagtgggagaaactccagccccacagctccggcccccctcaccatttacactgccctgcccagcagctttggccccttcccaggcagatgggctgggctgggcaggaggagtacccacctcttacctcctccacacctttcaggcctgtgcccgtcctgtccacaccagacaaccgtggatttggtgaggggaccaaaagagcctccatctaactcattttcaggaaaggctcaaagccagcatccctgggccccagagagctccaggccacaacccctgtgggaggcagtccttaaagctgttaggatccacctgccatatccagagaccgtgaagaggagggagagctggggccctgggaacagacccttgagccacagcatggcagggctcctggtaccactttgcccagcagtttgccaagccaaacattgcccaggcctgggccagttgtcatggggccttggcttggctatcttgggggagagagcaggaaaagcccattcagcaggccatggggtgagatctagagtttgcactctaggggcatcaactactggcaggtaaaccacaaggcgcagaaggcttgggtcagcacctctcatgcttcaggagttctgactcatttggaatcttgataaactagaatctgattcagtgggtgtggggtagggcacagcccgtgcttctgagtgctcctgggcgaagccactggtcctcagacaacactttgagcagagaggccttagaaagccccaaacctggctgggcaccatttctcacacctaatcccagcactttgggagacttaggtgggtggatcacctgaggtcaggagtttgggacaagcctggccaacatagtggaatcccaactctactaaaactataaaaattagctgggtgtggtgacatgcacctgtaatcccagctacttgggaagctgaggcaggagaatcccttgaaccctggaggtggagattgcagtgagctgagattgtgccactgcattccagcctgggtgacagagtgagactctgtcccaaaaaaaaaaaaagaaagaaagaaagccccaaaccggaatggcaggctgggtctatagtcaaaccaggtcctgtattctatggtacagaagttttattaatactcaccaacatttgccctgcccttgaggggaactgataccagtagttttcaaagtctgacaccctcaccactacaggctgcagcagcagccctgtgaacttctgagagatccaggttcctgctccccgtgccaagcctattgagttaggagtctgggtgggacctatgaacaggacccccaggtgactggggtgcacactccagtttgaggcccactggtttacaaagcgctttcatctcattgaggacgcttagggcaaagcagccactgatcttcctgccgatggcttttcagagtcacagagggctgaagagagtgaggctcttacctgcaaatggaagcaggtgggtacaattggctaccactgttcttaaacaaaaggaaagaggatacgacatagaatcctactgtcatatttttaatgaaaagataaaccaaaaaaaggaaaaaagttacctacagggagagggaagccaccaggggaggagagtgagagacagatataaaagccagtctgctcagaaatgtgccttgtcttgtagatttgactttgcaagcacacgtcaaataaaacacaaatccagactcagtggggagagaactatttgaaagatttttgcaagggaggaaaggggctactgcaacaggggctgggatggagagcactgcaaaacgcagaaggcttgaccatgccatctgcaagggtcttgagggttaggcgaaaagatgatctcttttgtagaaagaacaaggctagaaagagccaggtgtggaaagtgggatgaaagggtgatgtgattagataaatagatcagaaaatgtcaccctgaggcagcctctgctctggaggggctgcctgcaggctcaggctgagttggtcaaagttcagagtccaggaagaaggagtgaaacttacccaagtctggctagcaagcattttgtttccatggatcagtgggaacaggccgttcagctaatcatttatgaggcaaagaatgggaatttggagggtctgtgtctggcctttcatagataaataagggggacatccctcggccttatggaagtctgatgtggttgtctgtgtccccacccaaatctcgaattgtaattcccataattcccacatgttgtgggagggacccagtgggaggtaattgaatcatgggggcgggtcttccccatgctgttctagtgatagtgaataagtctcatgagatctgttggttttataaaggggagttctgctgcacacactctctcttgcctgccaccatgtaagatgtgcctttgctcctccttgccttccaccatggttgtgaggcctccccagctatgtggaactgtgagtctattgaacctctttcctttacaaattacccagtctcaggtatgtctttattagcaatgtgagaacagactaatacaaagtcatatggggaaaggtggttttttgcagcatgttgttttcctggaaaacaaaaatgtgaggagaatctctcgttttggctttttgttgttgttttgttttgttttatgagacagggtcttactctgtcacccaggctggagtgcagtggtgcaatcatagctcactgcagcctctgactcctgggctcaagcaatctttccacttcagcctccagagtagctgggattacaggtatgtgcaaccacacccggctaacttttttaaattttttgcagaactgggatctcattatgttacccagcctggtcttgaactcctggcctccagggatcctcctgcctcggtctcccaaagtgctgagattacagattgagccactgcacctggcagggggaattcctttaatcttcactgttttccaggagcaccgggctcaagtaaaattcactattgtcatatgtaatatatgtttttgataattgtaaaacaaaactaaaaattttttatagcagcccctataaaccagaagacaaatggaagaaacaaatctgttcatatgcaggtggtggcataatcacacagagaccatccccaagtgactttaaggcacagaaatgtgactgtaggttcccaaagaggggcatgccctaaagacaaaaagagttgccaaaaaaatcttaagccattttcactaaacatattgtcagtaataacgtggatgttattattcctcaactaatgtatattatagggcaaaacatctaattctgttaatgtaattaagagcaaagatttttcaatgtaagaaaaaataaaaaaataaaataatatcaaagaagaaaagccttttaatccaacccaaaataagctttctctttataaaataggcatccatgagaactttggctccttgagacaacaccattgactccccgtgagtgttcaggactttttcctggccacgggagatggaggagtactggactttgatgacggggaggttccttccagttccaacattctgccagacttatgcagctcgttctatctttgcctcccactttacctcccttttattttctctttgatataaggattgccatttcagccgggcatggtggctcacacctgtaatcccagcactttgggagaccgaggcaggcggatcatgaggtcaggagttcgagaccagcttcaccaacatggtgaaaccccgtctctactaaaaatacaaaaattagcagggtgtgacggtgtacacctgtcgcgcctgtaatcccagttactcaggaggctgaggcaggagaatctcttgaacccgggaggcagaggttgcagtgagccgagatggcactgctgcactccagcctgggcgacagaacaagactccgtcacaaaaaaaataaaataaaataattgccatttctaaaaataataataataaatgaagggatgaatgaagggtgaaaaatatcgggggtaccatttacattgtactgtagtactccttggagttatgctattcagatgttctaggatggatggatggttgaatggacgggtagaagcaaggaatgaaggagggaaggaatgtaggagacgaaggaatgtaggaggcgaaggaaagaaggaagggaagggaacggaaggaggaaggaagggagggagggaaggaaggaaaaggaaaggaagatccatgagtatgaatgaatagatggttagatggaaggaagcaaggatgggtaggtggtagatgggtggatgggtaaaaaggtgggtaggtgggtagatggattggatgagtggatagaaggaaggaaaggtggggggtggatggatggatagatgaatggatggatggatggttaaatggatggaaggaagggtgggtgggtggtggatggatggatgggtgggtggatggatggatggatatataaaaagatgagtaggtaggtagatggatggatgtgtggatggatagaggaatagatggatgaatggatggctcaatggacagatggatagaagaaaggaaaagtggatgacagttggatgggtggccatggtcctatgaacaagttacgctctatatacagacccagtggaggatacacttctgcaaaggagcacctgtgcaaagcagaccttccccagagaatgtccaaacctttgcctggtatcttgtatttatgcaggtggcacttggcccagcagaatcaggtatggagggtggttatttaaccaaggtctacagctcttgatatggcagcccctgaccttcaagcacttctgtgtggcagtgcccaatgcaatgatgtgggacagagcgcacattctgaactctatatagaagggttgggtcaatgctggtcaccatagtgacgccatttctgctcttaaggatctggtaaagacactcgggatggaacagggtttcactactccttctggataactacagtgagtcagggagtaagagagaagtattagaattaagtctgaagtcccctcagggcaccagagaaccctggcaggagattttgtccccagccctcggcagaaaggagaggagcttagtgctcaactccccacagagactcacctgcacacctgtatgccgtccagacctggctcaggggaggggatgctgtcaggagaaggttccagccaggtgaccccatgacctagctgccagctctgctcccgccaccacttgtggactccccaaggcagcggctggctctccacccagctccagacacagactggtccctgagcgagaatccgtttctgtgaaggagaaagcgttaagtgggccacgccctcaccccttcctctcagcctgggcatcccgaggctcccacaagctcactgcaggcgtgcacttgaggccagtgtgttttcctgggagcaaacctcctccttcctgtgaggtccttcagggcactgagaagtcccacccagtctcatggggacccactcgggatgttttttgctttttctaagagaagccaaatgtctcctttaatggagaactaccataaaaaacttctcttaaaaatgcttgctttttctgagttatcagaattaacccagaaagaggtcacaaacgggttaggtccattagccactcagagtaactaagtaatttgcaagagaactaacagcctgggtgtcctcagtgttcctgggccaggccagcttccccggcaggcagaggtgcactgtcatcaggaggcatgagcggtttgctgctgggtcacgccctgtggtctgcttgttggggaaaccacccaccccgacatccaccctgcccagcaagcctggcggtggccatggtcctgccagcgggtgctgcccctctttgctcacatgtgactcacagctcccataacacagtaagagcttcccaaggcacagccagggcaccaagctaggtatgggctgcaagcatttccttttgcaattaataaacaagaactagcacttataaacagtcaccatctacccaagtctcactatcttcacaaacaacgctccataaactgaggctctgaggggctctgtgtcttatccaagttgactaagcaaatgagaggctgaaactcacagttgtctccagagtccctgctctttcttctctgcattgccagcttcctttcttccgctgggagaacagccatcaacccagccggcatccccagctctctgggccttacagtgggtggaatgttccttctgtaaaatagggagccagggggcagctggaccgacctgggttcaggtttttttgttttatttatttatttgtttttgagacggagtttcgctcttgtcgccaaggctggagtgcaatggagcgatcttggctcactgcaatctccacctcctaggttcaagtgattctcctgcctcagtctcccaagtagctgggattacaggtgcctcccaccatgcccggctaatttttgtgttttcaatagagatggggttttgccatgttggtcaggctggtctcaaactcctgacctcaagtgatccacctgtctcggcctcccaaagtgctgggattacaggcctcagccaccgcgcccagcctgggctcccaattttaactgagcatcagactcagctaagccttaccttctccaggtgtgctcttcagaccagcagcctctcctgggggacttgtcaggtggtggaccctcaggccctgctgagaccttctgaatcaggatctgccatttaaccagatcctgccccaaagcacattcaacatttagattctcagactctaccctagggagttcaaggtggcccagaaaccaaccacactcccaaggcagcccagaaaccgaccagcaacaggggctttggttgaaacttccctacgcggcccagaaaccgaccagcaacgggggctttgggtgaaacttccctaggcggcccagaaaccgactagcagcggggcctttggctgaaactttcctgctggacgccatcgtcctgggctccttggggaaagcccagggatgggtggctagagttccagttgttactacatggtgcctggattgggaggagagtggcttctttgcctctgcttggatgggcctactctcagctttatggagtattctttggaagttgtaggcgaccattctcctgccattgagatctctgtcaggcgggttgctccctgccctgccgtcagtcctcgagcggttctgtcttcaccgagtctcttcatcgtgagtgcaatgagcttcagagaaaaggaaacgtattggactttcacttggaactctagggcagggagtggcctcgcaggctggtgagaactgaccggccctctttctcatctctcttgggtccacggcggtggataggcctcttgagtttctccatcgtcctgcatctgggaatggctttccctgcttcccagcacacacgatggcccctcatctccccccccacccccagctcccaagttcacatcctctggcccaatctgggaaggtgcccctcaaaccaccatggagtcagccatggccagcagagcagggtaggctgggcactcacactgggacagcaggcacatcttaggagagtgagggggctgcacacagatggggaagccacaaagactcccgggatagcagggacgaggggggcccccaacttacctcagtcagaggcaggcagagaacggcagatctgactactccctgccttccccacacaccctcgcaggggaggcaggccagctagtacgcccatgtgtgggctgagtaaacaagacacagacacggtcccaagaccactggcttgtacatggcaaaattcagccctggtacccaaggcagagcctggaagggagtaagagaggagggaccagagcgagggaggagggaccagagcgagggaggagggaacagagctaggggggagggaacagagcaaggggggagggaccagagcgaggggggagggaccagagcgaggggggagggaacagagcgagggaggagggaacagagtaagggaggagggatggaccggctgggggagcacagggtgtgcttcatggtttcaagccagggcccaggttctcaaccctgctgctcaccacagtcacctgaagaatttgcagaactagggctggtggtggccctggtggacaccattaagtcagaacacctaggggtgggctcagctgtggtgtctcagtctcagcgcctctgctgtaaaatggggacaataacagccctccaacaaggttgtcgtgggatttaatgaggtgacctggcaggagcgcttcaccgggggcctggaggtggtaagtgccaagaaacagtggccatgttcctgtggtctcgagtgatgttacaactccctggcaaggtgggcagtggcacccgctatggagatgggcacgctgacctggttgctaaagtgactcacccaaggccacacatggaggaagctgcagcgcgaggttgtggacccagcaccctctgactgtggagtgtgactgagttgagtgtccacactgctgcctcagtctcccaaagtgctgggattacaggcatgagtcaccacacctggccattttaaatgttttattaatgtactgtatgccagcatgatataggtcaaagagtgttacagttcacaaaccacctttccccacctgccagtcctgccctccagccctgccaacacctggattttagagttctggcctccagaaccgtgaggtcataaggaggtgttgttttaagccaccgagcttgtggtaatttgttacagcagccacaggaaactaatacaacatccctttttttaaaaaaaaaaagaaaagaaaatttattttataagctcaacactttataagtcctcagatttcccttgtttatttccctttgggctttgtgggttgtcagtaaagttccgttggaaaaccctgccagcctccttgaagccaaaagaaacacagaagcaggagccagctttgcccacgcttggccaaggagaagaaagatcggggccggcaaggggctgagggcggggcgctttgagccaagagagcaggttaagaccaggctctgcaaccgacaggtgctatgaccttagaaaagttatttacattccctggaactagagcttttcatctgtaaaattcattcaacattcactccacaaatggcttattaagctctttcctacatgccagacactgttcctggtcccagagatacaatgatgcacgtacaaggaaaaagtccctgctctcatggagcatatattatacagggggaggggagaaaacaaacaagacatgtaaataaatatatagtatgcttgttaaaaacgccaaggaaaaagcaataaagcagggagaaacaagtgtccttcagtaggtgaatagttaactagcttgcggtccatccgtaccgtggaatactacttagttaataaaaaggaatgaattattgatacacaacaatgtggatggagctcaagagaattctgccaagtgaaagaagtcaacctcaaaagatcacataccctgagcaacacagggagaccctgcctctaaaagaaaaaaaagttagccagacgtgatggcatgcacctgtagtcccagctattcagaaggctgagacaggatgatcacctgagcctgggagttcaaggctgcagtgagccatgactgcggtactgcattctagcctgggtgacagagtgagacactgtttgaaaaaaaaagtcacataccatatgattctatttatatgtcattctcagaatgtcaaagttatagagatagggaacaaattggaggggttagggataggtggggtagagggaggtatgattataaagaagtagaatgagatctttgtggtgatagcatagttctgtgccttgattgcagcggcagttacacaaatgcacacatgtattaaaatagcataaaactacacacatattggaccagttggaatagtgtccatttcctggccatgctgttggatcctagcaatgtaagatgcaagcattgggggaaactgggtgaagagtgcaagggtcccttctgtactatctttgcaacttgctgtgaacctataaggtagtatatttgtaatatatttcaaaattaaaagttttcaaaaatatatgtaaggcaatatagactaaaccagggaagaaggataggcactatgtgggtagcaggtgttaaaattttggacagtgcctaacaatatgttactacttgtattagtttgttctcatgctgctaataaagacatacccaagactgggtaatttataaaggaaagaggtttaatggactcacagttccacatggctggggaggtctcacaatcatgtggaaggcaaaggagaagtaaaggtacgtctaacctggtggcaggcaagagagcttgtgtggggaactcccatttataaaaccatcagagcttgtgagacttactacaacgagaacagtgtgggggaaactaccccatgattcaattatctccacctggcccttcccttgacatgtgagaattattacaattcaaggtgagcttttggtggggacacagccaaaccatattactacttcagaggacaggtggatggtttaaatgagatacgatatgaacttggaatgctgttcatactcaataaatgctagtttatgattctttttactggggagtttagtgttgtgttatatttaaataactcagttttttggttgaaggaaacctgtgtataaaaaaataaaaatattaaaattaaataaataagaaactcagctttttagatgtcacaatagtatggtggttatgtttttttaagttcatcatttttggagacgcacattgaaatatctgccaatgatatgatatgaggtctgggatttcaaaataaaacagaacgcaaaatgattggttgtggttggcagtactggtgatggtttggtgggtgctgggctacgccttggtgggctgagttacaaaggtggtaattgtgatggttaattttaaatattaacttgactgggataagggatgcctaaatattaatagctgataaaatatttctgggtgtgtctttgaagttgtttctagaagggattactcaatatataatattaatattgctatttatctcaggttctctagaagcagaacctgagatggaaattctgatgcaagtgatttattgagggagggaggaaagcaggacaggccctggaggaagctggggaaagatgtggcttcatgagaagcccagcctcaacctaaccccaaaaggacctttagggcataaattacagctcagaggtcaaacagcaggtgttatgcttctgcatcaatcagtcattggccatgggcatcaggggaggggcagctgcaacctcccaggcatcttggtggaaaagaatgacttgaccgattagtgatgtctgcaatggatgtgagaggggaaatggtggctgtgtatatgcttgtagtcttgaggactgctcagacctttctaacatacctctctagaattctaacaggtaaccatttcctcattcattcaccacatattgactgagggactactgagtgctaagttctggaccttttgcagggccttcaaggaacttactgtctgggagggaaaggaagacacaggcatagagaaaatgtgccaagccatatgaaagggcacagggtaaaagctctaagcccacctcatcactgacagctgttcaatgaggtcagtcaggaaggactgtttcccagcaatacaaaaattccaaaattaaatttaaacagttaaatccctgggttttgctcattcttcttacatatgtccaactctccgggcttcctccatggtttccaggtggcacataacatgttcactgaaagctccagctctggacccagagagacctgggattgaatgccggctctgccacttactagattgtgtgaccttgggcaagtcacttaactctgagtctgtttcctcaactaataaactgatctaacaacagcagctgcctgatttgctgatgggagaaatgtaaagctctgagcacctgcttggcaagaggacctttggccccaagaggaaggaggttttctgcagaagtagacaactcctcgctcaccaagggaagcaggagagtgagagaggctggtgcagatggcccctgagaggcggaggtgggaccacctctgctactttctctttccctttgctggtggtccagtgtctactgctgccttcgcaattgaaaagcccgatccccagccgggtatggtggctcacacctgtaatctcagcattttgggaggccgaggagggcggatcatgaagtcgggagatcaagaccatcctggctaacatggtgaaacttgtctctactaaaaatacaaaaaattagctgggcatggtggcacatgtctgtagtcccagttacttgggaggttgaggcagcagaatcgcttgaacccaggaggcggaggttgcagtgaaccgagatcatgccactgcactccagcctgggcaacagagtaagactctgtctcaaaaaagaaaaaagaaaagcccgatccctgtcttggtcctgcccataccaggccccccctcgggtgagtctctgagcctcgacttccccagtggtaacaaggctggagtgcagcaggaccctgggagccgcagccctgctgtgctgcctgacaccccaccaaaccctgagggaaatactcatatgtccccatatgatatggtttggctgtatcctcacccaaatctcatcttgaattcccacatgttgtgggaggaacccggcaggaagtaattgaatcatgggggcagatccttcctgtgctgttctcctgatagtaagatctggggttattatgagggggagtctccctgcacaagccccctctttgcctgctgccatccatgtaagatgtgactttgctcttcctcgccttctgccatgattgtgaggcttccccagccacgtagatctttgtaaattgcccagtctagggcatcagcagcatgagtacagactaatacatcatatttggaggggctcggacagggcctggagggcacacaccccatatcagtgagagaaccaagtggcagtgggggagaaatatcacctacagccagatttgcttccttctgggaagcacccgggaggcattttggggtgggggatggcatgactgggctggaggtaacctgggcatccccaagcctctcaaagcccttcatcccctccccatggcctcctacctgtaatcctagcactttgggaagctgtgacaggaggatcactttagcccaagagtttaagaccagcctgagcaacatagtgagaccctatttctaaaaaataaaatttgtttaattagctgggcatggtgttgcatgcctatggtcccagctacttaggagattcaactctacctactttatagaaagagaaatgcctgtcttaatggtccagacaattgcatgttccatcccacacggggagcatatttcccctaagtgagtataagctggagatgtgagtccagtcggctgctctcaactgccccgcttggtgaaaacatcccaccactgcatgtcattctgatgtttacccatacgtattcttcacccagcctgggccctccacagagaccaacgactgggcgaggcccttgccctaagacccaagaatctgtcccctgagcccgggaggtggagggaaaccagccgtgccagtctgcaccatagtgtttgcctagggtatgtccaagggaaattttggtgaagcaaggtacatgcccgatgcaaggccttagaacctcagcccatgaggaaggagctcctctgtcctttagccaggagtggtcggagcagggagaaggagtggtgaggctcttggaagtgggacctccatggcttgagaataaagtttgttcctagccgacctaacgtcaccatcaggctggccctcaccttgcccataaggagaataaaccagtactaccagtgtgcctgcttggaggttcttgggtgagtatcttgggcatttccagaggcagccacccccactctacccaaccctcactgaggctttagggccctccccacctgacgaccttaagcctctgatgaaataaaaagtatacagtttctccttagaaaagttggggcccctgaacttgatgcccactgtttccccaacatatgagtggtaagaagtaatagagaacaatcctctgtgcccttcacccagttccctgcacaggcaacatctcaccaaactctggtccaacaccacgtgtacagaaccaggatgctgacacggacactcaacacacggagcacgtccatcaccacgagggtccctcctgttgctgtttcatgaccacgctcactttcctcctgcccccactgcctccttaacccctggtgccagtaatcggttctgtattcctaaaattttgtcatttcaagaatgcccttgaatcccatctctacaaaaagtacaaaaaattagccaggcatagtggcgtgtgcctgtggtcccagttacttgggaggctgaggtgggaggatcatttgagcccaggaggtcaaggctgcagtgagcatgattgtgtcactgcactcctgtctgggcaacagagttgagaccctgtctcaaaaagaaaaaaagaaaaagaaaaaaaaagaaaagaaaagaaaagaaaactcttgaaatggaatcatgtgatgtgtaccctgtaaggattgtcttttttttcactcagcatctttctctggagatttaccaggtgtttgcacatgacaataacacgttcctttttattgctgtgtagtattcatggaacggatggacacaacttgtgtaaccattaatgtggtgaaggacatcagagttgttccaagtttttggctctaacaaataaagctgctgtgagcttttgcgtacagggttttgtgttgttggggccaagggaacttcccctttgtcctctgaaggtcctctggaaaatcaactcacaaaaggcagattcattggagaaaaggcgtacaaatttacttgatcatagttttatgggacatgggagccatcagaatagagacccaacacccaggagagtgcagaagcttagacattgtcctgaggttacagaaagaatggaggctcggatgctggcaaagcaggttgtaggaagggagagaggaggaactttgctgagggccaataaaggattcctatggagaattcaatgggcttgaggaacataaaagcatctggggcaaagtctgttgggcctgcagagcggacaatggtttgtgacaaaagtctgcccaggtttgttaaaagagaattccttccttgcaatatgggtttagttcatgaaaactcagagaaaggatcagaaggcattgttttcttcttaggtaggtctggacttcaggcagataaggaaacttcagagaatccaatgctttggagaacagttgggctggggcagtcagagagaccttgaaactcctttttcagttcagcatgtccaacatgccatattttgaaacatccgcttctgaaccccaacaatgtgaacgtatatcttcatttttccttccttccctccttccttccttccttccttccttccccctccctccctccctctctctctctctttttctttttctttctttctttctttctttctttctttctttctttctttctttctttctttctttctttccttctttctttctttctttccttctttctttcttctttttatttcttctttcgagacagggtctttcactgtcgcccaggctggcgtgcagtggcgcaataatatctcactgcagtcttgatcttctgtgctcaagtgctcctcccaccttagcctcctgagtagcttgggaccacaggtgtgtgccaccatgcccagctaatatttttttctttttttttttcttttgtggagatggggtctcatcatgttgctcaggctggtctcgaactcctgcctgagctcaagtgatccacctgcctcagcctcccaaagtgctgggattacaggcatgagccactgttgcctgcccatatatcttcatttctttggaataaatggaaagcaaccattgggtcgcatggtagttgtatgttcaggttttaaagaaactgtgaacatattttccagagtggctctaccatttcatgttcccaccagcagtgtaagagtgatccagtttttccaaatcctcaccagcattggatgttgtccctgttttttattttagccattctgatagatgtgcatcactgtggtttcaatttgcatttccctaatggctaatgatgttgaacatcttttcacaggctcagttccatttgcatatcctcctcaatgaggtgtctcttcatgtctcttgcccattttcaaattcgattgtttggcttgttgtttgagagtttgagagttttttaccctctctagatattagtccttattgctaaatttgttgtggtgagtggttgaagccttcgagccctgttctgcagttttccttatgagtataatacacacacatctggcttcataaaaggcagggtgcctccccagagagggagctgggcaggttgacggtgctgggtcactccagctgagatcatttgcaagcctgtcttttacagcccttggttctcttcaaaccccatgggcatattgtgtctctggctcccagttcttcccaccacctttcctataggtggcttcatcctacacactttggagatggtcatgataccttgatgatgacagagggcttgcacttctccctacaatgccatagatctagcccattccttaaaccgtctcaaaaaggcacctccagcccttttaacctttgatgccgtaccctgtcctgttgttctttgccacagattccagattcctatagatccgtgtcactcattgtgaatcaaagctattctgcaggacacagaataaatggcagaaagggaggtcactggaaagcttcatgtagaatcatagctcagggcaggacagcctgtgtgctgcacgcttggccacaccagccaacggttaaagaagtcagcactgcaggggatgccccagagagggtgagcaggaaattgcaatctacatagacccaaaggtgcagaggaaaggtcacaggaccgggcatcagagccccctgctcactgcaggtctctctgtgtgtgtggcaggggcgtggcggggggagaggaacaggtgtcacatgacctctgtccctaagcatctgaactgaagaagtaaagaggtcagccagcctcctcccactccagacctctgggatacttaaagtaagtgttgcagggtttgtagcatcttggaacctttcttcctacatcacagaaaaaaaaaaaaaaaagtccagtgaaccggttccacctcttaagaaactgtggtttctacagcctgaacttgagcaaaactggaacatcagaaaattatttcctcctgccccatctctgatgtaatagcagatccagtcctcagctctgtttctatagagaaagctgggtgaacgggatgggtctttattgagttccctttgacgttcttccaaaaaatagatgtgattttcccctctccctccctctgtctccttccatcatccttgcctcctttggacccatagaagggggttcttgtgggaagtgatgatctctgagccaggccctctttcagatgagctatgaagttagtttgtttacttatttttttcatctaaaccccaaataccacagaaccagcacctgcaatttttcctaacacatcctttgaacttgctgcaagttaaactgtagaggtttcatttctcagttgtaattcagggtgtcttccccatgccatttgcttccaaggagcaacatcttcctccctttctaccccaactcccatcaacaactgaaaaaaacgagaaatcagaacttcagccacagcagcctttcctggctctgtgtgaacaccgtggagaggatacagcccttgactccctggccctcctccctctcacgtctaagctgggaacaccataaacagtcacagtgctgagccaggcagagaggcagacgggtacagccagacgggacagatgtaattagcagcatcattgctttggtgtgcagaatagatagcagaatgccgccacccacatgatgctttggcaaatgtactgtcgctcattttcacaaacaattcaataggtcttttaaaagtgccgacaacaagcaaagaaagtcacggaaagaaaccagagtgacaactcagcccgagtgccaaagttacttgagagctgctctgggaacagtgaagccaaaccaactccgagttcaatctgatccaagttcagatggacagagcctggcatccatggggcaagcagtggtgcccgattcatcgtcagataaagtgagctcagatgccaccgtgttcctgatgtagctgtcacatgatgcctctgagtcgtactttttccatctgcttaatgggcatgttgatcctggtgtgtgtatttctagacttgctgtgaggctggcgggaggccacttggaagggaaagtctttgtgatctacacagtgggggtcgtcattaaggaagagcctcaggaattgcagccacaaggacagtgccattcctaaggtaaatcacgggaagaagaagcctcttaaccccacctcctacagcagcgagcattaactcctccccagtggcaattccccaggcctctctcctcatgaagcccaaggatcaatgaagtaactcttacattctccagcacccacatggtccagtctcgagccattgtgcagctggagaagcacagtccagtgtgtttttcttctgtttccccagcactctgaaggagagcccaacaccaagttctaataatttattaatttttttatttttaatgcatttttattttattttattttattttattttattttattttattttattttattttagaaggagtcactctgttgcccaggctggagtgcagtggtgcaatctcagctcactgcaacctctgcctcctgggttcaagcaattctcttgcctcagcctcctgagtagctgggattacaggcatgtgccaccacacccagctaattttttgtatttttagtagagacagggtttcaccatgttggccaggctggtttcgaactcctgacctcaagtgatccacccacctcggcctcccaaagtgttgggattataggtgtaagccactgcgcttggcctttatttttatttttaaaagacagggtctcactttgtcatccaggctggagtgcagtggtgtaatcatggctcactgcagcctcaaactcccaggctcagacaatcctcccactacttagcctcccaagtaactgggactagaggcatgtgccttcatgcccagctaattttttattttttgtagagatgggggtctcacactgttgcccaggctggtctcaaactcttgggctcaagcaatcctctcacctcagactcccaaagtgctgggattacaggtgtgagacattgtacctggtttgggagcctattaaaatcctcatttctctcctatccatgtctctcaccctggcagccaccctggcacccccttcacttctcccttccctcttctgccccttcctgtatcatgtagctttgcctggcattttttccatgggcggagatgatgtaagccagctggcaatgacggggttttcaaaggcagctggtaacagaggaaggctcgcagactaatacttattaccccactgccattgtttcatttaatgttgtcctcaaagctctcctgggttcaaacttaaaacccatgcaagtgtcaaaacaaatcgtgcctttttgagtatttttttctctcctggatcttcctttcaagcttgtttcctaccttccctccgggtgaaaatgaagatttgagttcctattttctttctttttttttttttttttgagacggagttttgctctcattgcccagggctggagtgcagtggcgtgacattggctcactgcaacctccacctcccaggttcaagcgattctcctgcctcagcctcccgagtagctgagattacaggtgcctaccactacgcttggctaatttttgtatttttagtagagatggggtttcactatgttggccagtatggcctcgaactcctgacctcaggtgatccacctgcctcggcctcccaaactgccgagattacaggtgtgagccaccgcacccacccgatttcctatctttcttgagaagcatcttccaaaacgtaaatgcacagactctcagagctgaaggaagcctcagggtccagctagtccaatccccggtgatgtctgaattccccttacaacatcctggcaggtgaccacccagcctctgctcgaatgcctcttgggagcaggaaccccccttctaccccctgaggctgagcagaccatgtttgatttttttccaagaaaatcttccccaaagggcaccttagccttcccatcccacaaactcaactcccagtggtcagtggtggtgttgggaggtcgaaggaggtggcacagaagtgtccacaccatccctggtgtacagcaggtgcccaaaatgtttaagcagatgaacgttctcgaggaaaatgatttaaacttgatcaaccagttactttcaagaagggagctccatgagtgtggaggcaactgggacacacgctgctcaccgggactgccaacaaaaactgggtgcaggatgtggctctgccggcacctcacacccggggacctgagcaactcactcggcctgtgaccccacctcttcacctggacagtggggctgacggtccctgctctgtgggcccacaggccattttcagttttagtggaaataatgtatatgtgaactggaaaggacttgataaacataagggttattcttattattcttcctattattaaggaataaagaccacagaacagtcccaacgtctccatttataatcttatttatttatttatttatttatttatttatttatttttgagacaaggtctcgctctgttgaccaggctggagtacagtggcgtgatcatggctcactgcagccttgacctcctgggctcaagcaattctcctgcctcagtctcccaaatagctgggactacagacgtatgccaccacaaccagctaatttttgtagagatggcatcttactctattgctaggactggtcccaaattctagggctcaagcaatcctcctgcctcggcctcccaaaatgttgggattgtgggtgtgagccaccgcacctggcctcaatttataattttaataattctccaaggagatattgatttttcatagaaaaagagcccaaactcctcctacctatcaagacttggggaaaatggcctcatttgacatgtgtagggtggagtagggaatacaaattagtatcactccatatccctgaaaaactgcagtaacaccgttaaacccaccctggcagcaagtcgtgccctgaagatgcgttgcttattcctctcccctctcagctgctggaggaacttgagggcagggctgggcttgctcctctctgggtcgggcacagcctggagctcagtgactgtcacacgagaagtcctaggccagcaagtatgggagttggtgaggggcattcagtggccactgaaatgaatctctcattggcggttgagcccttcttttcctgctttttcccattttcttccctgagagtggactctgttgatatgctttggctctgtgtccccacccaaatctcatcccaaattgtagtccccacgtctcaagggagggacctgtaatcctcacgtgtggagggagggaggtgattggatcatgggggtggtttcccccatgctgttctcgggatagtgagtcctcacgacatctgatggttttttaagtgtttggcagttcctccttcacacgctcttctctctctcctgccaccatgtaagatgtgcttgcttcccctttggccatgattgtgcatttcctgaggccttcccagccatgtagtactgggagtcaattaaacatttttcctttataaattacccagtttctggtatttctttatagcagtgtaagaatggactagtacatctgtcaaagaggatttgtcctaacgcatatgaggacattgagtatgagacattttacagttcattggtgtttgccctgaaactccaatggccccttattccccgacaagatttatctggggtgtgcttgatggaaaggttccagggcctgaggctgggggctcctgaccaagaaaggggctttgaggaggacagagcactggactgggagtccaaagacagtcctcattccatcctgtcagcttgggtatccccattccccctcagcctgcttcctatctatgccaggagggctgaccagggctgctcccaaagatctcacccacctctgcggtcattaaactgatggtgaaagtccttgaggtggcctgaggggtaataacttgtaaagtcagacgtccatgggtggaacagagcagagacggccacggaactcggagggtgtaaacagctccaggcacccaagccaagtcaggcactggcagagagtttggcatctattttctaatagctaagggaaataaaaaaaaaaaagcaaaaaaaacttgcggagttatatatttcctgtggaatgaaacattctcaaagatctacttcctggatccgtacttgcccgcctctaacagagccacgaataaggtctctgaccactggagacacgacaatggcactcagccaggtggcctatcagtcgtcacggagaataaaggcactgtctctactcagactgtaggaaggctggcctccagggccctttatgttccttttttttttttttgagatggagtcttgctctgtcacccaggctgcaatgcagtggcgcaaccttggttcactgcaacctctgcctcccgagttcaagtaattctcctgtctcagcctcctaagtagctgggattagaggcgcctgccaccacacctggctaatttttgtatttttagtagagataaggtttcgctatgttggccaggctggtctcaaactcctgacctcaagtgatccacctgccttggcctcccaaagtgttaggattacaggcgtgagccaccgtgcctggccccctttacattctgaagacctaactgaatgcagcccgagagcctgggtgtctatcagtgtttcccaaagcattgttgtgcatggctttgaacacacaaaacatggagtgttcaaaccctgcacattccatagactggtctggcccttgatgggatcctaggagatgacctctaggccctcagaaaatccagcccaatcagactgtctttacatgctgaggcctgggccatgccagatagtttatgcaggcagtgtggtttatggttggagacatgggccatatggtatcagtttaacctctggaggggctagagactgagtcactaagatcagccatatggatgttccacacctatgtgaatgatcctcaatttaaaaaaaaaaaaagccgggcgcaatggctcacgctgtaatcgcagcactttgggaggccaaggtgggcggatcatgaggtcaggagatagaaaccagcctggctaacacggtgaaacactgtctctactaaaaatacaaaaaaaaaattcgttgggcacggtggcaggcatctgtattcccagctactcgggaggctgaggcaggagaattgcttaaacccaggaggtggaggttgccgtgagccaagatcgcaccactgcactccagcctgggcgacagagagagactctgtctcaaaaaaaaaaaaccctggacaccaagacttcgttgcacttccctggttgcttcatgtatgttgcctcccactgctcctgggagaagtaagtgccgttcacatgactccactgggcgaggacaattggaagccgtgcctgtctatgcacctttgctggtttgaatctggatcctttctgagtataactcagagcttttctgagttctgtgagtcctgttagcaaatcagggaacctgagagtggtcttggggacctccccccaactcaatggtctttggataactttgacaacctactctatcagtttttctgagacagagcctggagtgctcattttattaagtttctcagatgtttctgaagcatagcaaagttaagaatcactgcttgagagaaggaagtggtgttttctgtttgtttagttgagacaaatatatgtgtgtttgctttgccttcaattagcttgtaacccttacaaccggaattaccaaacattgcacttgtactgtggtccccaaactgtccatccaggcacccagatgccacagcaaactcacaggcatgccatcgaatattttattttattttattttatttatttggagacagactctcgcactgtcacccaggctagagtgcagtggtgcaatctcggctcactgcaacctcagcctcccaggttcaagagattctcctgcctcagcctcctgagtagctgggactacaggcgccggttaccacgcccagctaatttttgtatttttagtggagacagggtttcaccacattggctaggctggtcttgaactcctgaccttaggtgatccaccctgctaggcctcccaaaatgctgggattacaggcgtgagccagagcgcccaggctgaatattttaaatcttcaatggctagatagcagtcattaacaatgtgtgaaccagctccaggtagttcacagtttcaaagcttggtcatgctaccttccttttgatggaatcatatcttcgcacagctgggttttcggtgattgctgtgataaaaagtaagtaccacacaaaaatcaatgggtacttgtgtgggacaggaaatcagggtggtgatgtcaatctgattccaaggtctgggaagctgcgtgatttccatgagcatacacacctcagtagtgagcagctttggttgttttacactgaaatagaaatgctcttttttctttcaatttatgtatgcattttttcccaatggctgctaatatttattaaattaggacacaaatacttataaagttgtttggacctaatcacttaatatatggaattgttcgattttgtttgatcgaaggacaccatgaaaaaattactgagacactaaggatatcatgaactgaaaaaattcaggaacctttggactaatgggaagggtcagcataagtaatattgtttccttctcagaagtgaaggaaatacaagttaaaggacaccaagaagaaacaataaaacaaatccagaacatgggtcgttttacactaatacttggcctagtgtcttcaaaatggtattgccactacattaaaaatagattgaagattggtctacattgagagatattacaatgccaacttttttttattggatcctggtttttagaagtacatttcaggtcaggtgtggtggttcatgcctgtaatcccagcactttgggaggccaaggtaggctgatcacttgaggtcaagagtttgagaccagcgtggccaacatggtaaaaccccgtctctactaaaaatacaaaaattagctgtgcctggtggcccacgcctgtaatcccagctacttgggaggctgaggcacgagaatcgtttgagcccaagaggtggatgttgcagtgagccgagatcactccactgcactccagcctgggtgacagagcaagactctgtctcaaaataaataaacaaataatttttttaaaaaaggacatttcaaaatgttctatagcttgggaagtttgaatatggagtaggtattagatgatattgggaattattgttcattttattaggtgtactaaatgtccttgttttaggtgaagcattatgtctgattttctttaaaatagtttgccagcaaaacatgagcagagaaatgaatcatggcaaagtgttcattattaagtcaaggtaatgtttttgttatggttgtgtttttacttttcggaatattttgaaattgtcctaatacaaagtttgttaaaagtgatgggttagtggtaaactgagcaaaatgatttgcactgaataggcaggaatataaaaatatggacaactccactgaaactcctcccaactctgccacagaatcggacataggcaaaatggcaccttggctgctgaaggttttgtgaagtagccaatctccctaatgggaaaaatcagaatacaacctcaaaaagctcatgcatggaggaggaggggccaccttcttctcactccacatggctggacgaggagttgaggacagagtgtgtggattatccatctgctgagaactgagacaccagagctgggcgtcaggatgacagcacagtgagaggcccaggaccctcgataccccatccccagcatcaccacagctcctggctcacgtcgaatgttccacctgggtggacttctcaaggagatgcttgctatgatcagaatgtttgtgtcctcacccccaaattcatgttgaaactaaaagccaaagcaaaagtattaagaggtagggcctttgggaggtcatgaggctggagacttcgccagtgaaattcgtgcccttatcaaagaggccccagaaagctgcctcaccccttctaccatgtgaggacacagggagaagacgtccatctgtgaaggaagctggtccttgccagaccctgaatctgccagcaccctggtcatggacttcccagcttccagactgtgagaaatgtctgttgcttctaagccattcagtctaaggtattttgttaccgcagcccaaatagacaaacacagtgttccttaaaaactgccaggcacagcggctcacgcctgtaatcccaacactttgggaggctgaggtgggtggatcacccgaggttaggagttcaagaccagcctggccaacatggtgaaaccccgcctctactaaaaatacaaaaattagctgggcgtggtggcatgtgcctgtagtcccagctactcaggaggctgaggcaggagaatcgcttgaagctgggaggcagaggttgcagtgagccaagatcacaccattgcacttcaacctgggtgacagtgagactctatctcaaaaaacaaaaacaaacaaacaaaaaaacactgcatcccaggctgggtgcagcagctcatgcctctaatcccagccctttgggaggccgaggcggcagatcacttgaggtcaggagttacttgggaggctgaggcaggagaatcacttgaacttgggaggcagaggttgcagtgagccgagatcgggccattgcactctagtctgggcgacagagtgagactctgtctcaaaaaaaacaaaaaacaacaacaaaaaaaactctgcaccccagatgctagaaatattccatagccgaatgcggtggtagttatgagtgtgtagacaaatggagacatccatagagctctccacttaagatttgtgtactttactctttactgaaattaggtacgtcttagtttttttaaaaaaaattccttccaccaaaaaaaaaaaaaaaaaaaaaaagaagaagaaaaaatgcatcccagtgagctggggaggaaagagtgaaattgtagctgcttatctgggaagcttcagaaataaaacattttggaacgaccaccccgaggtagaagacgaggatttggaaatacacttttaaaataaagtgatgggaggctgggtgcagtgcttcacacctgtaatcccatcactttgggaggctgagtcgggtggatcacctgaggtcaggagtttgagaccagcctagccaacaagatgaaaccccatctgtactaaaaatacaaaaattagccaggcatggtggcatgcgcctataatcccagctacttgggaggctgaggcatgagaacccaggagatggaggtcgcagtgagccaagatcatgccactgcactccagcctgggtgacagagcaagactctgtctcaaaaataaaaataaaataaagtggtgggaaagagagacgtttagtatctcagccacactaaacctttaagcctctgtgcacacagccagtcatttcttgatctctttgttaatataactttagtatcaggcagtttgttgtacaaagtcctgcagttcttcaagtaataaactcacatcaaaacactgtttccgagcattaaaaaaatatatagcattgatttaaaaaatgaatgaactgaacaaaggtctcccactaatgaccctcgtgggatatttgagagggttttggagccagcagaggccaaactagagagtggggcggggtgggggcggggacggtagtcaaaaacgtcagcgcaagcccaggaagtacctcgaaacctcatcttcctgcccgaagatgaactgcctgaactgtgcggggcagaaaggatgggagcagctgccccaccttcctgcccagtcccagcctctggggagagggtctccccagggcacccttctgggagagacaaggagaaaagttggtgggaggggacggtctgaccaggatgggtgcccagggccttggagggtcctcccgtgctgcagggacccgcaagaaccccgggagctgcctccctccacagctcaccagctcccccgtgagctcaagccaggaatttcaggcaggctctcgggggtccccagacttccttctactccaaggagcctggggagcccgggacctcccagaaaagcatgtgggcagctctgccctaggagaccatggttcttgtcaagaaaaagtcaccgaagtccaagaggctcctccaaagaatgtctactgaattcccttccccttccttcggacacaaaatgtctggagaggcaacaacctggttccaggttggaaatggagccatattacgctgctggggcacccaccactcagatctccctctcacttctctggcttccccctgcatgtccccttctgggcccaaatcctctcctgagagcccccccacccctggtttcgagcctgcaatcatttgaatgacattcaggtccagctggctgcccgtcgatcacgactcgaacgcggggtaacatcgtgtgcatgtgtgtgcgggggactggggggacagtgaaagagtcccaggcaaggatccaggagtcagacccggccgggatctgctacccttccctgcgcaccttaggcagaccacacgacctatccctggtttggtggcctcataataatcaccaaggtttattaagccgctgtgcgcaaggcactgtgctgcgcacattgcatgtattatctcattggattttatatagtgctagcgtctgaatgtttgtgccgcccccgacccccgccccaaattcacatgttgaaaccgagtccccagtgtgatgatatcaagaggcagggccggctggggcacagtggctcacacctgtaatcccagcactttgggaggccaaggcgggcggatcacttgaggtcaggagttcgagaccaccctggccaacatggcaaaacctcctctctaccaaaaatacaaaaattagccaggcgtggtggcgcatgcctgtaatcccagctactcaggaggctgaggcaggagaatcgcttgaacccaggaggcagaggttgcagtgagcccatatcatgccactgcactccagcttgggtgacagagcgagactccatctcaaaaaaaaaaagaggcagggcctttcgcgggtgattaggtcatgaaggctctgggtcggcacctgaatgaatgggaatcagtgctcagagaccctagggaacttgcttgccctttccagctgagcatgtgcccagcatgtgaggacataaaaggcaccatggatgagaaacaggctctcaccaaacacctcatctgtcagtgtctttaatcttgggcttcccagcctccagaactgtgagcaataaatatctgttgtttttgagttacccaggtattttgttatagcagatgaaacagactaaggcatagggaccaatattatcccatctaataattgagaaaacttgggcttgaaaagatccatgatggcttacgcaagctcacagggctaataagcgacggagctgggatagaatttaggcagttgaacttcatgacatgaacataaccacaattctcatgctaaccaatagtaaaataataataataaacaaataatgaggctaggcgcagtggctcgtgtctgtaatcccagcactttgggaggctgaggtgggtggatcacttgaagtcaggagtttgagaccagcctggccaacatggtgaaacgccatctcttcgaatgctacaaaaattggccgggcgtggtggcgcacacctgtaatcccagctactcgggaggctgaggcaggagaattgcttgaacccagaagcagaggttgcagtgagcgaagagtgcactgctgccctccagtctgggtgacagagcatgactccatctcaaaaataataataatgatgatgatagttgacagaggttcttttagtgctaaggttctggggaaacctgcaaatttagtaaaggtggacccacattttcatgttttcaggtcatgatgagtgacctcgctcctttaggaaaaaagagagaaatattccctttgggaggcacagggacagcctcctgggagatcagagtctcgcctctgcctctgcaatcagccaggatctgtagacacagatatttatgaggcagtctgcggtgctctatttcttcccccattcttatgggggtgagaggggcagaaggagaccaaaagccacatacttgcaaagtcatccttcctctggagaccaagaagcagcagattcttttcctgggaaacaagtctatcaggcagacatctgttactctttgcgatctgtatgccataacagtttaaaaaacagagtttaaatgcttaaagaagaagaaaacagtttgcctgtgttgcaaagcagcatataaacggtgctggaattagcacaagggaaacatttatctttcctagataatctcaaaacaggcctttttttttggattgtatataattatgtttattggcatggaaagatgctcatgatatatcactaaaggaaaaacaaaaaacaaaaaacaaaactggttgcaaacacaaactaggctttttaaagaagcattgactctgcctccctggctggggccggggccctctgtgtatcccatagaggaaagggtagaatgggccaagactggctgggtagtagccttcttcctgggagaacagagacagagtcacattttccagcaggaatgaccaaagatttgcctgagctggataagcccagcctggtgtagtgatggatggtgggctctggggatccaaaagacctgggttccagtcctagccccactatgagtcgtggtgacctagtgcagtttcaatgctgctggagctcacttctccactgacacagtggaagtcacatctcctgcacacaggggaggtgctcatgaaagggtgggcttctctccctccaatctgtgttttttttattgttttttttttttttgagatggagtctcactgtgtctcccaggctggagtgcagtagcacaatcttggctcactgcaacctctgcctgctaggttcaagcaattctcctgcctcagcctcccaagtagctgggattacagacatccaccaccacgcccggctaatttttgtatttttagtagagacggggtttcaccatgttgactaggctggtctagaactcctgacgtcaagtgatctgcccgtctcagtctcctaaaatgctgggattacaggaatgagccactgcgcccggcctccaatctgtgtttttatgacaaaggcatggattggccatgagcaatgggcagccctggggtggcaggctgtgaatgagggggaaggggctgcctcgaggggttcggtcccctcctcaggagctaacacacagcctgagacctgaaggatgagaaggagccggccacaccagggtctggaggaagccactctgcgcattggccgtggcccacgcaaaggctgcgggaagcaacatcctgccttgcttccggtcggcttcaggcctgtgaggctgggaagggccagtcgtggaggatggagggtgaggtgggactgagctacatgtcccgggccttggttatgatctgaattttgatgttgagaacaagaaaaagacacaaaaggggcttaagaagagtgagcagcatgaccaggtttgttcttttaaaaaactggatactaggccagacgcgatggctcacacctgtaatcccggcactctaggaggccaaggctggaggatcgcttagggtgaggagttcaagaccagcctgggcaacatagggagacccccatctatacaaaaaaaaaaaaaaatatatatatatatatatatattatatacacacacacatacacacacacacacacacacacacacacacatatatataacaaattagccaggtgtggtggtgtgtgcctatagcaccagctactcaggaggctgaggtgggaggatcactggagcccaggggtttgaggctgcagtgagctatgatcacaccactgccctccagcctgggcaacagagtgagaccatgtctcttaaaaaaaaaaaaagaaggatactagatgaagatgaggagcaggggtgtggcgtgaggaggacagaccagctaggaggaggagcctctgggcaagagatgaggtgacctggtcagggcccgtggccatggagatggcaggcatggacacggtgaagctatattttggagaagaatctagaggactttctgatgatcagatgtcgaagtgcaggacagaggagactctcaggccacttccagctgcccctacccagtggccttgtgggaatcaggaaaagggctcctctaaacaagcatgcagcacagggcacccgtgcaagaccctcaccctgagaccctcccttgcaagtgcgaagttgctcaagcccctgattctcactcagagacctggtcaattttggacttgcaaagcttgtagtgtctgtggcaatccaaggggagccctgggctctgcccaaggtttagggaccatttcaacacagtgattctacccctggctccagctgtgtgtgaagtttcttccctccctgcctgggcaccagactttttacagtactcactgcattggacgcaactaaccttgtgaagaaaagagtttttaaaaccctggaagctaatgttacaagactatttagcacttaaataaatgcaagttctagaacatctgcagccaaaatgaaagtaaataatgacagaatgtgagtcatgagtagtttgcaaagattgtaaacaaagcatcctcccaaattcagagccatggcctgagagttgggtaccaattaatcagcccttaactctatcacacacaaaaggacacgtgtcctcattagcaagtcatgaggggaacttagctaactgactgtcactttgctatctggagttcacttaaaactgaaataaaaagcttattccctgaagaacagagcactcatgctcacattgtttgaaagaatcacttcactgccagtgtcaacatgaaacttaacatcctgatatttatgggaaaggcaaaacaaccccgctcgtaaactgaagagatgagcccaaccacccaggcatgtcccatcagtccctctcccaggggctggtcactttctttctgatggcagttgttggtgcagacttcatgtcctctcctagccaattgctctccaagggcagggttaatgcctcattctttcatccccctacattcctgtgtctagtatttggcctggatgtaataggtgcacattaaatatctgttgtgtgagtggatgagcatctttcccaaaaggccaatgttcactccagccctggacttcccgaaggccctgtccaggcagaggatggaccaaaaagggagctgggtaggagacagaaggtttggctcctgtcccagactctgccactcacaagcatgtgctcatgtgagccacgtcatccattttggtgttcccatctctaaaacaggaggaatagctgtccccccactttttaagggtttgcgatgacgcgatgggaaagaagcacttggaaaggggttccacaagtgtgatgtggttcccctcacacctcagaggggagttctgcaattgagaaggcggggcagtggaggaccacggttagacatggtgtgcaacttactctcagaaagccagcaggtaagcagagtggatttggaggtataatgaatgactgcaaagtcacagaagacaaggccacccaggctgtgctctctgcacatgggaactagaaatcagagtacaaaatatggagccagcagataacacaaatatgggagtggcctgctgtaaggcaatagggaatggtggggcctgcagccaactagagattacaatcatgctctgcttcaggcatttgcaaaaagatttaaaacttacaccccatgaaacagcaaaacgcatctatggcctgctggctgggagtctgagacccctgcagatggctgtatcaagcatgtctttttttttttcaaatggagtctcgctctgtggcccagactgggtgcagtgccacaatctcagctcactgcaacctctgcctcccaggttccagtgattctcctgcctgaggctccccagtagctgggattacaggtgtgcgccaccacaccggctaatttttgtatttttagtagagacggagtttcaccacgttggccaggctggtctcaaactcctgactttaggtgatccgcccgccccaacctcccaaagtgctgggattacaggcgtgagccaccatgctgggtctctagcacgtctttttattccaatgctcacttggggccttgctgacactggagagactgcccctcccgggcagggccccctaattcctagagatagtaaacaactagggtgtacctttaatatgcaaagcaaccaatccagagcatgtaacccagatgcctccttgatcagactctcacactgggggccatgacccatctgccctaagcacctcacgggctggccagacaactagggacagtccctataccccagagcctgctgaaatgactcaaaccagcccgtccgaagcctgtttaccctgcttgccttttccaaagaaaccacagtagaggctcttgcccacattttccctctgggctgcctcctgaccctggtgcttcccccacgtggccctgcatgactatcgcatgccacctcagcttaggaactgcgagcaacaaactctctccagtggcagttgtctcctgactgttggcctcattaggcctgaatagtaagaaaacctgtattttcatacatctgtaaaccccaccggagcacagatcatcattgctgctttatttccccctgtgaatctcggcacctagcacagtctctggcacgttgaaaacacaatttctttctctttctttcttttttctttctttctttctctctctctctccctctctccccaccccgccccccccgccccctctctctttctttcttttttaagccagagttttgctctgttgcccaggctggagagcagctcactgcaaccttcgcctcccggattcaagcgattctcctgcctctacctcctgagtagctgaattactggcatgcgccatcatgcccagctaatatttgtatttttagtagagacagagtttcaccatgttggccaggctggtctcaagcttctgacctcaggtgatccacctgcctcggcctcccaaagcgctgggattacaggtgtgagccgccacacccagccaaagatacaatttcaacgctaatcgatgaatggatgggcatagggacgaaagcaaagggctgggtagaagcatctgtttggctacgcgggtccctacacttcagcctcacatttgcaattgcttcaggacactaaattctgcatatgcctcatttctgcgactggcatagacgtaggcaatcaggcaggagcaagccagagggagtggcataagttcacgctagtaggagtaaatggtgattaaactctgaggctcaccaccctgctggcattcagctcttcaggcagctcctaagtgggggcgggcggaaggcttttcttttaatgtccgatcttctggctaactctggctatttgctttattcaaactcttaaaaagagatggtcatctcaaagagtctctgcacccattgataaaaggggaaaagtcagagagcagcctcctcgcccaccttcagtctctgggacctgcccacaacaggctcttccaaagggagtcaatcaggtcgccatgaagcctccctacgtctgcaatggtgcagtgggctgtccccacatccctgaataaccgaactgcatccggttaataaaccgaaagctgagctagagaacctgtgttgtttttcatctttactctttaaaatgcatcaatctagccaggcgcggtggctcacacctgtaatcccagcactttggaaggctgaggggggcagatcacttgaaggcaggagttcgagaccagcctggccaacatggtgaaaacccgactctactaaaaatgcaaaaattagctgggcatgatagtgggtgcctgtaattccagctacttgggaggctgaggcacaagaatcgcttgaacctgggaggcggaggttgcagtgacctgagatcatgccactgcactccagcctgggagacagagtgagactccatctcaaaaaataaaaaataggcctggcgcggtggctcatgcctgtaatcccagcactttgggaggccgaggcaggaggatcacgaggtcaggaatttgagactagcctgaccaacatggtcaaaccccgtctctactaaaaatacaaaaattagccaggcatggtggtgcatgcctgtaatcccagctaatcaggaggctgaggcagaagaatcgctttaacccatgaggcataggttgcagtgagccaagatcatgccactgcactccagcctgggcaacagagcgacactctgtctcaaaaataaataataaatgcaccaatctgctctgcttgacaatgaactgaatttctctgatcacggggcccttgtgtgtcattctcagcataaccgtctccttcctaagttctggaaataggcagagagaagacaggcgcagagtaggcctgtctgggaagtacctgaggagggtggagaagcctgtgtttgctgtttctgatgaatgttgttgggttatttagtgcttggcagtgaacggttccctgaagaccatccctttcccaggccctggatggaagggcaggaaacatttgaccacagtgtctagacagcgaggctagggaatctggggggctgcccaggagctcatatgggggacagccatcagtagggtaactgacccagactagaaccagattagggcttgtaataggcattatcctagtctaattattgagatcaccccctcttttctcccaaaagtgtcctagtttgattgataaattatacagccaccttcaacattagtgaattttgcaaacaggaaagtctgagttgggaggctcacacgcaacagaagctggtcactttgtacaaatagaaagggcttagcaaacatcctggaaaaggcctggtggcagcacccaaccccctacaaatagcaggaacaattcaccaaagggaactgagcctgaccttggccctggtgggctctgctctaaaagtggagttcctgggctggcggggacagcctggcccaagcgtgccccgcctggcccaagcgtgccccattcacagcctcctcacccaagaagggcaggcttcaaggcagcatttcttttccccgttgaagtctcaagccagagttagcaagttcagcaaagggcaggagcagagaggaaaggattatgatgtgtccccgatgggtacaggagaagggaacagccccaccaactccaacctcagtacgcacctgtgctacaatcccattcaacaacaccttgagttgccatggggaccctgaacaatttcccacttgtgttttttttccttcctggttgagatcttgtttctgtcaagatgaactatttatctgtgttgcatgaaatgtcatgggttgtggtcaaaaccaggaccaacccacgcacaagaaataataaccctttgatgacactcacacacaagcttcccaagtctttagaggctgtcagtgattcattttctttttccagcactgaacttgctctcgagaaatatttaacccaaaaggcgactggcaggccatacccccagtagcctgggtttgccggatcaactcatgtttgagttaatttaccaagtgacctgtggacatgcgtccactcaccagagaggcagagcaaacacttacaaggtaaaaggtagtgtgatacgtttcaccttgtggccttacatgaggtttaattaagctacaaaatgctcgacgtgtccagtgttgaaggaatctctgttttgtaaactaaaacttccaagttattattattctttttttatgttagcttagccatcatgcaaaatttactggtgaagcagttaataaaacacacatcccattgaagggttttgtacatttcagtccttacaaataacaaagcaatgataaacccggcacggtcctgagaggaaattcctttgcttcttaaagctgccagtcccggctttttgggggctcatgtgttataaattctggaagctcttttagctgcagtttgagcatcaggcaaatcttcttcctcttcctcggttcgcttgtgttttaaaaacaagtcagactttaagaagcggctgtagctgtcgtacttcatgagattaaagatctaaggaggaaaagaaaaaagagtctgaaggctgaggctaatccaggccataaatcatcccatcagatatgtattaatacctaccatgtgccaaagaatactaacatgtgcaaagaacacactaagaaagctcaaataagtcatctgctagacaaggcagatttcctggagatttttggtcattatgcaataatctcaatggaatatatagacagtcacatgaacaaatatgcctttattttccacggaaatatagattcacacagcactgattcagacccttgtaccaagaagtccttcaagactctccactttatttgcctagataagacaaggatgtatttctccaagagcttgagacagccgaatagaaaccatttctgtagagacagtggtgttaaaaagatcactgacatatcatatgatgccagcattgttaagactcccagtaagtctggcatccgagatctcaaacaaacctattattgtaccaggagtcaaaatgaggcgtgctcactgcagggcagggcagcaaaactataatcttagcaagggaacaggtcccaaataaagaatagagcagccagctgcagaatgccaacatctgtgccatcagacaggctggggagcacatccctagaatgaaacaactctaaggtatgtcaggtgagcgaagaggacacccgacagagctgaagtgccccagattagacggctgcccccgccggcatggcaggtgctcagagggctgtccccaggcacagtagcttcctctggccgccactgaacctcttttctgggccacagtccttgtgaccagcattcattctcccccactgctacccaatcctgtgccatctgccctcctcccttgccccaggaaaggggcagagaaagagaagcacaaagccttttccagctgtcaagggctatgatctctttcccacccctcatttctctctctctcagacctttccacttaactcgcagtacactctgcaactaaaaatccacatggttcaccctggtacacggaacaaccaagtggaaagttccagagatgtctagaatgtcactgactgccaggcggggttgtcaagtggatggtaaaaccctgacatcttttaaggctgccctctcccaacacacatacactattttgtaaattaaacatctgagggtgctgggggcggtggctcacacctgtaatcccagcactttgggaggtggaggcaggtggatcacttgaggtcaggagttcaagaccagcctggccaatatggtgaaaccccgtctctactaaaaatacaaaaattagccgagcgtggtggcacacacctgtagtcccagctattcaggaggctgaggccaaagaatcacttgaacccaggaggcaaaggctgcagtgagctgagatcacaccactgcactccagcctgggcaacagagtgagactctgtctcaaaaaaaaagaaataaaataaaaattaaaaataaaacaaacatctgagggactcaaaggactcagaacatctgcttggaggatgggaggtgcttcaggagggaactggaaccctcaaattttacaccttcatcttcccaagatggcttcaaccacagcagaactgcctgagtcactgtgctataaacagagtccacaacccagagaaagacctgggactttaggttttctttaaactgttaaactagcgcctgcccatcccctggtgcccttctagtcttgcccgagtcctccagctgctcagcaagaccctgcctccttaagcccctgtcctgtgccacactagagcagtcatctatcttgtagccatcctgtaattccaggtgtgattgtaatttgctgaggtttacagaaaaaaaaaacaaacttttttttaatcccagaaaatacaaaaatcatagccagggctgaggtgggggatgagaaacgccattactccttcatggcctcccaccgacgtgctaagcaagcgtcaccatctgccttattcagcccttccaggcacaagagtccccaaggggaaactttcagaggctcacctagttcaaagtctgcaatgaacgctcaaatgtgactaatgaaaccagttgcacgaaggtcccacctggcacccagcctcagtcctgtacccactcccaccccaggtccacgcagatgggacccaccactctaagcaggatgcggtgcgacccaagcgtctcgtgtgaagtctgcatgtgggagaggaacatcctgtttgcctgtagtggctctgaggctcagacttcaaagtagagaagaaaaaaggccggtgctgggggcacccagggcagaggaggagggggagggaaggaggctgcttcggctgggaggaagctcaggggctgcaccgggctggcaggactcgaccccgagatcccgagatcccaaggctgccagcaagcctgaggggagggggctgcgaactatttattaagagcataagggccactccctactggggcaggtgtgaaatgccccacgagtgcagaagtccctcaggcagaggtttcctcctctgagagcccttgcccatctcccgtgctgctgcagtgactgggaggcagctgtggctgttggacccagacaggctggagaaaggagaggatgtcgcccccaaagccctcgtgcgcctgggctgtgggaagcctgattgctttacatggggtgcacgggcagacttctgactgccaccggccaacgaccccctgggcctggctcaggagcacacagcaacagggtgctcctgggacggggctcagcaaaggtgacttagaggatggagaatgcaactaaggccgggtgcggtggctcatgcctgaaactccagcactttgggaggctgaggcgggcggatagcaaaatcctgtctctactaaaaatataaaaattagcagggcttggtggcacccacctgtagtcccagctactaaggaggctgaggtgggaggatcacctaagcccgcggaggttgaggctgcagtgagctaagatcacgccactgcactccatcctgggtgatagagccagaccctgtctcaaaaaaaaaaaaaaaagagaatgcacctaaaactttcttccaagaaagtggccagagatcgtgtgcccagctactggccagagcctcatctatcacagggaaaagagctgtgactggggcccagtaagtgtttaccagtggctgaagagaaatcgtgcgctgtgcagcagcagaggctggggaaatgaacccggctagtaccaacgcggctgcagtgccctccagccctgcgctgggcagcgtgtgggcattctttcattcagttctccctccagcgctctgaagacccccatttgacagaggaagaaacgaggggcttaggggttcctcacagttctggaggctagaagtccaagtcaaggtgccatcagggttggtttctcctgaggccgctgtcctcggctcgtagaccacaccttctccctgcgtcttcacagggtctccccggtgcacgtgtgtccttacctcctcttctcacaaggacactagtcagattgggttagagctcacctcaatgtccttgtttaatgttaattacccctttaaagccctatctccaaataaagtcacattctggggattaggacttcaacatatggattagggaggggagcacagttcagcccataacagtgagcaaaagagaagggcggaaggccagccctggcaggctctgcagcccccactcccaaccatgaggccatctgccactcgcatggcaggacaataaaaacgagggctgcaaagagagtaacatggaaaactgcccgtgaatgttaaatgactgatactaaattttaaaaacacaccctatctaaaaacaatgatcccaaatacgttcttttttgttgttgttgtttgcttttttgagatggagtcccactctgtcacccaggctggagtgcagtggcacgatcttggctcactgcaaactccgcctcctgggttcaagcgattctcctgcttctgcctcctgagtagctgtgattacaggtgtgcgccaccacacccagctaagtagagacggggtttcaccacattgaccaggctggtctcaaactcctgacctcaggtgatccaccctcctaggcctcccaaagtgccgggattacaggcatgagccaccacgcccggctccaaatacattctttaagagtgtatccatgtgtctaagtgagaaacaatatgtccccaaaggtcagtagtggggtgaatggtgttcccccaaacttacattcacctcgaatctcagaatggacctcatttgaaaagagggttgcataagggtctcaaaataaaatcatactgcatttagggtaggccctaaatccagggactgggtgtccttatcagaagaggaggggacacactgagggaagaaggcgtgtgaaggcagagggagacatcggtgatgcagccacgtgccaaggagcgctaaggagtgccggcagccaccagcagtctgtaagctgaaggggcaagtaagcaccccccacaccctctcgccaccacccaccagagtcttgtggagaacagggccctgccaacaccttgatgtcatattttcaatccgtttctgctgagcgaatacgtttctgctgtttgaagccacttgacttggggtcattgcttatgacagtccaaggaggctcatccagttggcttgttgatttcacctcaccccggctcaaacacagaaaatgagatgggcctaggggtcccagacagttccaacaagcagggatccctgagggggagacatgacctcaccaggtttggactgtgatgggcacctgaacaacacggtcagactccttaagggtccacaaggcagagaaagaagaaaatggagctatctgggctaagcaggaggccgcaggtgagtggaagacacgggaacagagctgaggccaccatccgtccaacaaacggctgctggtgaagcggaaaactcaagttggcggctgagctgcattctgcatctttttttttttttttttttttttttggccaagacagctgcggcttagcaagctttggggttttggcagccccacatctgcaagctgcacgcctggactgtaaactgtttagcatcgttgccttgggatccaatcctacaggctgctggaagtgagactcggacaaaaatgaggagggaggcttcctgcagatgtgcaactctgcacaaccgtcctgcagaacaaggtctttatatcaccaagccacctcctctccagatcccagacattgccatggctgagcaggatttgccttcctgaaagaaaaatatccatgcagtgccccaacttcagactgttccaaatgtgccgctccaggaaaggacgtccccctgacgcatactcatctgtgcagaaacgaggacctcaaccagccttgaaggcccctctgtgaatattgcgtcactgtctccattcattgcgtttcaagcctaataaatattttaacacttctcagaagacaagtacagaagacctaaacaaaacatgcatcctctcttctcttcaaaaccctctgccattttattttaatccagcacaggaggaaaaaaatcattccttaaggcaatgaaagtttaattagcgggatatcatatctgctttaagaacttggtttcgcttgtatatgaaaatcgctgaaagaaggtggaagcaccgccgtctctgaattgcggctctagaatgcgtcctctcttcacacacatggactacagacgtgcttttgtacccacgcgaggagacagaaagggggaagaaaggaagctcctgtccctccagccctcagaagtggctgggcattgacgaggctgtcggggcaaggcgcaaacagggatgtgcctaccccctaaagtgaagaccacctccctctcaagtgggaacgggctgcacccaggaggaggtctgagggcagctggcagacagcagatgagcagacgaagcagctcaagtcagcccttgccccagagcgccaggacgggccacacagaaggctctgtcgccttgcacggctctccagcttcacgacagaccagccagagatggacagtgtgccaggggtgggattggaactccagaaggagtctggacaccagcgggatcagagagacctcgcttggacgatatcccctcccaagctcacgggttcacgcgtgtggcggtcacacgtgtggagcggattgtccgcttttttctaccgtccacacgattcaaattccaggcccaaatgacatgactcactttctgctgggggtgaaggcattttaattttgccttttgccatcggaaggggagttgaatgctcctctgagtgccactctcccctcctcttcccccaaatacttttatttatttattttttttgagacggagtctcactctgtcgccaggctggagtgcagcggcgcgatctcagctcaccgcaacctccaactccctgattcaagcaactctcctgcctcagcctcccaagtagctggaattacaggcacgtgccaccacacccagctaatttttgtatttttagtagagacggggtttcaccatgttagccaggctggtctcaatctcttgactttgtcatcctcccgcctcagccacccaaagtgctgggattacaggcgtgagccaccatgcccagcaccaaataccattttaaagttgcaagaaacatctcaaagtatctcgaatactgcccttcccatcctgaccctcgtgaggcagatggctacggtgtacacagacagccaacctcccttctgtttgaacaaaaaaccacacctgccctttctagcggagcatgctggaaaatacccatttcttccctgcatttgatcttttggagcaaatgtcacctggcacccataagactgacacatcctaagtccctggctctggccaccaccacagcctctgccaccacccaggagaggggaccatggtcatgcaggggcactcaggccaaggtcctgtttggagaaataatggggcaagggagagaatgggcccccaaatgactgccacaggccggacagcccctctctcaccctccgaggccctcaatagctggcccacccctcttacttacgttgaaaaaggaagcatttttcccctcttacgttctgggaaaactcaaagaaactgcattgctaaaaagggaccccattcatggctcctttctctgtcaaggatgtggctgggagcactagcatctcacccaaggctttttttttttttttttttttttgagacagagtctcactctgttgcccaggctggagtgctgtggcatgatctcagctcagtgcaacctctcccttccaggttcaattgattctcccgacccagactcccaagtagctgggattataggcacatgcaaccatgtccggctactttttgtatttttagtagagacggggtttcaccacgttggccaggctggtctcaaactcctgacctcaggtgatccgcccacctcagcctcccaaactgctggttttccattttttttgtaagcaccagaggctgaggacttctttttgagtggagaaggccacctcatctctgcttttccaggctagagtttagcaccagatccaaagcctcgggaaggcaccctagcagacgcaaactctgcttgtgtatttatttattttgagacagagtttcgctcttgtcacctaggctggagtgcaatggcacgatctcggctcactgcaacctccacctcccgggttcaagcgattttcctgcctcagcctcctgagtagctgagaatacaggcgtgcaccaccatgtccggctaatttttttgtattattcgtagagacgaagtttcaccatgttggccaggctagtctcgaactcctgaactcagctaatccacccgcctcggcctcccaaagtgctgggattataggcatgagccactgtgcccggcccaaaatctgcttttaagtgtaggcatggggacccctgatattcatggaagaagaatgagcaccccacaaccccaaacccatgcccttctcttccatggactgagaaagccacgaagctgccatgtgcaatgatctggacctttctatcttcatcaagctcatggctgttccagaccatgctgcgctgtatatagaacttaaaccaaaggcttctgagcaagaaaggtgtgtaaactggggctaagaaatgtgccagaggagaattttgttttaaatctttcatatggaacaactttaagtcactgagcagacttcaatgtgttccattcttcaatgtttgagtacagcctgaaaggaccaataacgtcatcgatttcctgctaagaagagagaaggagcggcaggactgggggatcttaacttttcacttcatacccacctggacacatgaattttcttttctttatcttaacaataagcatgtactaattcaataacttaagataattttaggccagacactgtggctcacacctgtaatcacagcagcactttaggaagccaaggctggaggattgcttgagcccaggagttcaagaccggcctgggcaacatagtaagaccccatccctagaaaaatatattttaaaaattagccaagtgtggtggcacatgcctatagtcccagctactcagcagtctaaggttagaggatggatcgagcctgggaggtcaaggctacagtgagccatgatggtgccactgtattccagcctcgatgacagagggagacccagtataaaaaaaattaaaataggcagggcgcagtggttcatgcctgtaatcccagcactttgggaggctgaggtgggcagatcacttgaggtcaggagttcataaataccttattattataacctccacttcacaaatgagaaaagctaggcacggagagggagcaagtcttgtccacaatctcacagtaactaaattctaaagtgaaagaaggccgggcacagtggcttatgcctccaatcccaacactttgggaggtcaagatgggaggattgcttgaggccaggagtttgagaccagcctgggcaacatagtgagaccccatctttacaaaaaattaaaaaaaaaaatctgagcatgttgacgctcgcctgtagtatcagctacttgggaggctgaggtgggaggattgcttgagcccaggaggtcaaggctacagtgagccaagatcacaccactgtactccagcctgggtgacagagtgagaccctgcctcaaaaatatatatataaataaagtcaaagaagttggggtaggggcagcagggggagtcagatctaaggaaataaggctgtagttatcagtgactttttaacaccagggcattgaacgctcatagactgcttggcagcgcagctcagagaggtagcagagtatttgcccaaagccccatgttacagatggggactcagaagccacagtaagaaacagaaccctcctggggtcagacagcggcagggctggactagaatcccccacttctgcctctggtgctcagggccaagctcatgcatgcactgtgataacagtgatgaatctggcatctccatatccagggagtgatgggcagggggagagggggaaggggggagaggggaggggcagagctcaggccactcccactcaccatacaaatggtgagccacagtcaggaggtcagggtttcacggctgactttctaataacggagctggctctgcaccaagccatccgccttctcttgcccaactggtatgggacgggcacagccctgaactagggacctgagccaaggggctcaggctgtaagaggtccaagccttaccagcccaaccagcacattctataaacagccactgttcacatccctgcaattaaactgtctaccacagcctcggggcctgacccagccagtccctcccaactgaactttcaccaccccctcatgtgctacattcctacaatgctgaccccctaacgcacctgctgcccctgcctcggggcctttgcgctcacctctccttggaaggtcccggctcccaggtcctctcatccagatcccgcttgccattcagatcccagtcacctctccagggagccctccttgagcacagaccctagcaggcctcttccagtacctctcagctcatcccctgttgcatttccttcttagcattgatctttctctgccctccgtgtgggggcagatgctgatttccctgttgtacacacagttcctagcacagtccctggtacagagtagggcctcagttcataattgcagcataaaggaatgaataaaacaacaaatccacaaaccagcagaccaacaaggactgaatcaaaactcctaggaatagatatttttgtttatttgttttttgagatggagtctcgctctgttacccaggctagagttgaatggtgcaatctcggctcactgcaacctctgcctcctgggttcacgccattctcctgcctcagcctcccgagtagctgggactacaggcgcccaccaccacacttggctaattttttgtatttttagtagagacggagtttcaccgtgttagctaggatggtctcgatctcctgaccttgtgatctgcccgcctcggcctcccaaagtgctgggattacaggtgtgagccaccacgcccggccgtaatacatgtttttaaagaagaaaagacactgtaaggaactgcaattccctgaagaaaccacctctttgtaaggtaacccccttccttcctgcttcctccaacttaaatttgtccaacggcagcctttgactctaggctaacgtactagggaaatgcccacagcaccacctttcgcctctcctggctttgcctccaaagggctgggcacaccaagcttgcagaactgaattaaatcagagaaccatctcgccacttacatgaatttcccaggtagcaaagctttaagcccctcaagcttctcttaggatgcctttggctggacacagtagtagctcacacctgtaatcccagtactttgggaggccgaggtgggtggatcacttgaggccaggagtttgagaccaacctggacaacatggagaaatgccatctctactaaaaatacaaaaattagcctagcctggtgacatacgcctgtaatcccagctactcaggaggctgaggtaggagaatcgcttgaatccaggaggcagaggctgcagtgagcagagatggcaccattgtactccagcctgggtgacagaacaggactgtctccaaaaaaaatgtttttgatgaagtgctcattaaaatgaataatgcactcttcacataatacgccgacctcaatttcacttctacttgatggtttggggtcaccaggctcacttatcatgtcactgtcccacagcacagggatgcccatggtgcggcgtgtggcaatggaggtccccacgcccaggctcaggcctcggtgctgtgcttgtactcagtgtcatttctgtgtcctccctagctgtcagtgatcacctcttgctgctcatcactccatagtctctaccacaacttcaaatctgctatgaatggaaaaacctgttagaactgtgtgcaaaccaagaataaacaggacctgactgaaaactcttgaagctctcctttaaacagggtgcatgggagttggctcatctagcctggggctcagggaagattttcccgttcttctaggttccagcggtgccctacaaagtcagagctgccctactagaagctcagagagcagcggagccgcacgtggtgatgaggggctaagttcgggggcggcggtgctgaacacaggaaagcggctgctctgcggctccaccatgaagcccagcagtgctcagcaaagccaaagccgcgggagaggcttttgaaagttccgtgaaatcttgtggctccaaacatgttcccctcagcttcaatctccttcacttaggaaaacagagctctcgagggagcctttgcaagaaaaaaaccggggctaatgctgagcacgcattttgacagttacagcaaggccccggagagacagagttttcaaagcaaaacggaacacaggggcccttcacatggagactcactgtgaaatcggctctgattccaaataccttgttttcacccaattatgccttaggaagaaagttcgtggatctttctctctatgcaattaaaaaaaatttttttttttgaggtggagtctcactctgtcgctcaggctggagtgcagtggcactatctcggctcagtgcagcctcagcctcccaggcttaagcagttctcctgcctcagcctcccgagtaactgggattataggcgcccaccaccacgcctggctaatttttgtatttttagcagagatggggtttcgctatcttggccaggctgctctggaactcctgacctcaggtgatccacacgccttggcctcccaaagtgctgggtttacaggcgtgagcgactgagcccagccttccaataatagatttttaacaacagagtataacagtacttgctttacattcagcagtttggactgcacatctgtttggtgtgcataaacatatacattattattacacttattaggccacatctgttaggggcatgtgcatatgtgtatttatagaaaaaaagatggaaagtctacagataaaatactatttggtggttatctccaagtgtgcaattatgcaataaagaaatgatttcttctttatatttttgtttcccaagtttcttttgctgagcatgtgtgatgcttacagttggataaaaactattttaaaaaatttttctgaggctgggcctggtggctcttgcctgtaatcccaacactttgggagtccaaggctggagaattgcctgagctcaggagttcaagaatagcctgggcaacatagcgaaagttcatctctacaaaaaaaatacaaaaattagctgggcatggtggcacacacctgtagtctcagctacttgggaggttgaggtgggaggatcacttgagcccgggaggccaaggctgcactgagccgggttcatgccactgtgctccaaccagggcaacagagggacatcctgtcgcaaaaataaaataaaataaataaataaataaaattctttgtcattaaaaaagaaaaaaaaaacaatcagcctctgtcccctgtgtttcttcctttctgtgctggctaagcctcccactgaatgagtctaaggggcacgcctactcataaggtccagctccgttctgagctgttgggcaggcgggctggatctctcagagcctgcagtgctaccgcatggagtcagaactctcccattcctcatcctaccttggctcccgcagtcctgggaagtgggatgacctgcattcacaaagcctttccaatccctctgctccaggggcctcaccgagctttgagaaacagcaagaggctgcccaggagcctggcagagcaacacaggccatgatggtcatggggggagcatggtctttgaaggcagatggacaagagggaatctggcttccagcacttttgctccctgcatgacttaatgctaaaaaaaacacttaatctctctgaaccttgcttttctcatcagcaaaatgggaataataacactcattggagataaaatgagacaatacacaccaagtgtgacatcaggctcaaacgggcagtcctaaatggtagttagggccaggcgtggtggctcacgcctgtaatcccagcactctgggaggccgacgcgggcggatcagttgaggccaggagttcgggaccagcctagtcaacatggtaaaaccccgtctctactaaaaatacaaaaaattagccgggcgtggtggtgtaggcctgtaatcccagctggtagggaggctgaggcaggagaatcgctttaactcaggaggcagaggtggcagtgagccgagatcgagccactgcactccagcctgggcaacagagtgagacttcgtttcaaagaaaaaaacctgaaaaggccaggtgcagtggctcacgcctgtaatcacagtactttgggaggccaaggagggtggatcacttgaggtcaggagttcgagactagcctagtcaacatggtgaaaccctgtctctactaaaaatacaaaaattaactgtgtgtggtggtgggcgcctgtaattccagctactcaggaggctgaggcatgagaatcgcttgaacctgggaggcggaggttgcagtgaaccaagatcaagccactgcactccatcctgggagacagagtaagactcggtattaaaaaaaaaaaaaaaaaagaacaaaaacacagaaccaaaagcgaaatggtagttagtgttgtcattactgagaatacctagagcacagaggtcagtacaggttcgcaaccctggctgcactttcaagtgccctagggagctctgacaagattctgaggtccagggtggggtcgatatcctcatatggctacagtcacaaaaactgccttttcaccatacattccactccctttcccagcgcaaatcaatgcccatgcgtccttccgactggctcaaattcaccacttccaggaggccctccgcaagtctccttcaatagccaaatgtgaatcagaattcacatggaatatgctgcccaatgctaaccttttcattatgcctcaggggctacatgatgaactattaatagcttacagcattaggccaccagaagtatgtggaggtgtctggatatttgcacagaaacagcctgccactttgagttctcctgcttgctttctggagttttccgtctattcttaccttcagcaattataggttgctttctcagtacaggctcctcaaatagctccagcctcccctctaatctggactgagaaggcagataaactggtctaaactgtgtgtagaccaagattaaacaggcctggggggactcctgtggggcaaatctcaagcttagaattctggtccccactctccccaaccatggcccctcagtgtacctcggtctgcccggccgtatgagatggtttccagggagtctaacatcgggtgtttcagtaaattcttccaggcctggaattaatgtaggttttcaaatcaaggtgcaggcagggaagtcgggttacctggtcctggagtttctggaacatcagagggtgcggttcttccaggatcttctcgttgagccgagactgcccctccacgttgacctgtgatgaggccttgctggacagaaaggtcatgtagatctcctttgccttttcctgcatctggaggagacagatggggccttgtgctatctgcacacacagccttcccggcctgagccctgctctcccctccagccaggcccacaggagctgctgtggcaagagaaaggcaccccccacagcccaggggctctcaggccactccagagagaatttctatatgggagagcctgcactgccaagcccctacccccgccccttcatgcgcctgcagccacttctcctggaacaaaattgctgcattaaccattcagaagtgatgacagaaagaatcctggcccgcagagagcactcagtaccatttacagccatcctgtggccgggcacagtggctcatgcctgtaatcccagcactttgggaagccgaggcagattgatcacctgaggtcaggagttcgagagcagcctggccaacatggtgaaaccccatctctagtaaaaagacaaaaattagccaggcgtggtggtgcaaacctgtaatctcagctactcaggaggctgaggcaggagaattgcttgaacccaggaaagagaggttgcagtgagctgagattgcaccactgaactccagcctgggtgacagagtgagactgtctctcaaaaaaaaaaaaaaaaatcaagttaaagtatgcacacctactatccctaccagttattaagcgcccactgggctgcaggcacctgcttggagggatcccatttccttaatcccctggacatgcagcaaagggcattttcctgttagccccactttccccatgaggacacagaggtcaggagaggtggcatggcttatctgagagcttccgggagccttaggactgtttggctccaaggcctctgaattctgctcagttccacttccgcaagacacattggcccctccaggttgtgcggtatgcggccttcccaggcagggtgcatttccttttagctaacgagatactgagcacagcagtggagaaaacactcgctgcccgccctcaagtcccgagtgcagtcctgctgggaagcaggagccgtgagtaggtaccggcttcctgtttcacccgaaactaaccgaggctggctcaggagcactcactgatggtaaggagatgacttcacagtgagaactgtgtcttcaggacaggcgcctcagggcggggctgcaggcgcaggagccctctcctccagaacttcccctgagggctcgattttcttttagagaaaggagacttcctgtgctcatacctcgccaacagcaaaagcggggctgtttctctgaacgttagagtctaaagcatgaccttaccctacagagcaaggcagacaacaaatgcctctaaaatgcagccacacagctatgacatgtgtgtggggggcctggaaaactgcctttctctccaagagcccaactggggctccgcatgtgctgtggggcttggtttgggaaatcccaagctctgcaaaccttctgcccttaaggaaaccaccagaaggttttgatagctggggcatgaaaggaaggaagggtagcccttttttagttcagggcactggggacaaaagatcctgagaagccacggcctggccatgtcctgttctgcgagaaagcaagcctcaccagcacttgcagggagacggcccaggttgggtgaacaccgaaagccatgctgtccaccctgtcttcactgtcaataggagcaatgaatcgatgccagactcagtgacacaggagtctctccagacaagcgtggctatctaagggacaggtctgggggccatcctcgagacccaagggggtggcacttaggagctggccctgctgtcctctccaagacccaccagctccatgaagccacagcctccctccaccacccccattccgtcaggaagcaacccttttggaaaaccacttcctgttttaaagccacttcatgaaaggagaatttcggccaggcagatgagcaaactccatgcagaggtctgggggcagaaatcactttagacctcccctcctccccttgacattcacacgcacacacacacgcacacacgtgcacacacgcacacacatacacacatgaatccaggatatcttgagtgattctgaaatagagaagtgcaatgaatggcttgagtctttgaggtggggcagaagaggccgggggagaggaagtaggttccagtgactgcaggtatataagctttgagggtctcagccctgccctcttccaccggctgtccctcctgagtctgcgtgagaacaatgtggggttcaaggccctggctgaccagatgcccactgtgagcagctgcagggctcagcttatctcggcggagctaggaagtatgactgaaaagggaaaccctgagacggcgaccacaagccagtcacgggaaggcctggtgtctaggccgagaacatgagcagaaaagaagaaacagtctgtggagctattttgatagatttttccagagctttgttaaccctattctagctactgtccgggtaggaacagagctggtggagttgattctgtgtctgtggcctggaaggatggccgacttctcttccacggccctgacacatgtggctggccacagcctggaccagagagcccctttctccctggggagacctgaagtgtccagcatctgaggctgtcctggcaggtgctggagagggccccaccttggcccatcaactcggggactgcccaggaagcacctgcaccccagtgagcaccttccaggcaccccacaaggctgaggcccttcttcgaggcccagcagtggctcaactgtgacaatgctcagccagacgtcagctctcgaacccggctccctgcaggtgcacgatcaggagaagcaaattcactttcctatcagccccagaagtgcacctctatgcagacgaacagcaaagtcaccaggggcccaaagctcagaagagcgctgcttcccacactggccccgccctccccaatcgaaccttcccactggaaaataaaagatcccccttgaccccacagctctctacatgggggttaatggcctcaccacccccaatccctctttttttttttcaagatggagtctcactgtcgcccaggctggagtgcagtggcgcgatctcggctcactgcaagctctgcctcccgggttcaagcaattctcctgcttcaacctcccaagtagctgggattacaggagtccgccaccacgcccggctaattttttgtatttttagtagagacggggtttcaccatgttggccaggctgctctcgaactcccagcctcaagtgatccacctgcctcagcctcccaaagtgctaggattacaggcgtgagccaccgtgcctagtctccaattcctttttgaaatctcttaaaagaaaagcatgcacccctgcctccattgtccctcccattcattcctcacgctacacacaggcttccgcccagccagcgctgctccaccagccggctgacgctgcccaggcagcgaggcctctcagaccttcctctggagtgagctggccccagccctgctcagcattgcgactttcttctcttcccgcttccctcaccttgtaagagccctgtcctctcaggatccccaacacctccctgtgtctgtcccccagctcctgtctccctgtgtctgtcccccagctcctgtctccctgtctgtccccagctcctgtctccctgtatctgtcccccagctcctgtctccctgtatctgtcccccagctcctgtctccctgtgtctgtctcccagcttctgtctccctgtctgtcccccagctcctgtctccctgtatctgtcccccagctcctgtctccctgtctcccagctcctgtctccctgtctgtcccccagctcctgtctccctgtctgtcccccagctcctgtctccctgtgtctgtctcccagcttctgtctccctatctgtcccccagctcctgtctccctgtatctgtctcccagctcctgtctccctgtctgtctcccagctcctgtctccctgtctgccccccagctcctgtctccctgtgtctgtcccccagctcctgtctccctgtctgtcccccagctcctgtctccctgtgtctgtctcccagcttctgtctccctgtctgtcccccagctcctgtctccctgtcccctccgtgaattctggggtttcccagacttctgtccttggtgacaactctaactccatgtcccccccagatttcagaccaaccctcccccaagctactgacccatgtagccagttggtttctagcaatgtgggcatggacatcccactgacaccttgaattaacacaaaggaacagagtggtccccttctggctggcaggccctgtagcccctactctgggaagctggaaacttcgatcccctgtagccactccccacccccatcccgtctgctggcctccggctcctctccaccccgtcttcttccagagatggaatgtgggagacaattcctaggacaatgaaaggatcaagacactaactttactaacatcaatttcagaaagagaatgaggcaaagaaaatatccaataaatgatatgagaatattttcaagaactggctcaggaaatgagaagcagtcggagacacagcagatgactctgcagagacccagaagaatgaagccaagcccctgaacaggtggggagggggtgccaacgagaagcgcgtccggagacggcaggagctcgagggcatcaggtagcccagacggaattgatgagggcggcagaaagaagccatcagacccccaggtcctccaccccaggtcctgctccaaacttgagcagtcaggtggctcccccgccaccttcaacagaagagttgagttttcttatctaaagaaacagacccagggaggctccggaacagagaggcacagaggacggcaagaatgagacgccgaaccgaataaagggattcagggaaattccaaatatagaccccccgcgccagcaaaattctcctgacacagttaattagaaatatgtttagttcaggaacatatcaggcttatggccccccaggaagagactagagggcccttgtctggaaaaataaaaaagcagaaaaaactcaataggaggatctgaagatgtagtcaaaatctccaaaagcaaaaaaaaaaaaaaaattaaaaaataggaagaataaaacatgaaattaagggctcaatgcagggcgtgaaaggtcatcattggaaaagagaccagagacaatggaaggaaaaaaagttactaaaatgatgataacaataacaacataagaccatttcccagaactacaaatttccagattatatggctccacaaagaattcacacaatgaatgaactccgcctctgcctccaaagcccctgactgaacagttttagaatactagtgatgaaaagatcctgaccaggtggagtggctcacacctgtaatcccagcactttgggaggctgaggcgagaggatttcttttgggaccagcctaagcaacatggtgagactgcttaaacccaggaggtccaggctgcaaagagccgtgacctcactatattccagcctgggtgacagagtgagaccctgtctcaaaaagaaaagaaaagaaaattgctgggcgtggtggttcacacctgtaatcccaacacttagggaggccagggcaggtggatcacctgaggtcaggagtttgagatcagcctgaccaacatggcgaaaccccatctctactaaaaatacaaaattagctgggtgtgttggagggtgcctgtaatcccagctacttgggaggctgaggtaggagaatcgcttgaacctggaagacagaggttgcagtgagccgagatcatgccattgcactccagcctgggcaacaagagcgaaaccccattaaaaaaaaaaagaaagaaaggaaggaaggaaggaaagaaagaaaggaaggaaggaaagaaaggaaggaaggaaggaaggaaggaaggaaaggaggaaaggggaaaaatagaaaagaaaatagatcctatactatcccagagagggaaaaaaagaaaaaaaaaaaaaaacagaacagtttacatataaattactgattctcaacaaaagtagaagactaaggaataatgtcttcaaacttctgagtgtgtttcaccccagaattctatgctctgtcagattatcagtgaagtaggagagtagggaaaaaaataacatttccactcaacaaggtctttacatacctacctgccagaccccccttctcaggaagctattgccagctgtgttttgggctcttctctcatgagtcattctggagggaagaagtcattctcgtgtgctgttcccaaaatgagggaatgactcaggagagaagaggacttggatccaggaaatggaatgccttcatcctacaaagaggaaggaagttcaccatgtgtcaggcatgggtctagaccctcggagacagtggggaagaagaggccccccactcccagattccagaagacaaaccacacagaagacggacaagtaaatgacatggatatgtgaagttgttgaatgctggataatccacgtcaaggaatgaaccaacacaggtcctattaaaacaacagaggcgagagtgggatttgtatcgactcctcaacagccttagttgatggagagagaaaaatcctcccatggtctccctgctggaacagatgtgataagtttgactgtgaaatccagttaggttacgtgcacaacagaggattaaaaagaactggccgggcgcggtggctcacgtctgtagtcccagcactttgaaaggccgaggcgggtggatcatctgaggtcaggagtttgagaccaacctcgccaacatggtgaaacccatctctactaaaaatacaaaaattagctgggcatggtggcacatgcctgtaatcccagctactcagtaggctgaggcagaagaatcacttgaacccgggaggcggagattgcagtgagcagagatcgtgccactgcactctagcctgggcgagaagagcgaaactccgtctcaaaaaaaaaaaaaaaaacaaagacattcagttaggcgacttctcccagtgcctatgttcctccacactttttgtagtaatttagagcttactccctggttttacttcctaggcagcgggactcactagggaatgcctggagtcagaaatgtggctctgaattctttttttttttgttgagacagggtgtcactttgtcatccaggctggagtgcagtggcgcaatcatacctcactgcagccttgacctccctgggcaactacaggcgcactccatcatgtctagctaattttttttttttttttggtattttttgtagagacaaggtctcaccatgttgctcagactggtcttgaactcctgggctcaagtgatccacccaccttgacctcccaaagtgttataattgcaggcgtgagccactgtgcccagcctcgggcgagctgccgcttaaccactcaagtcatatccctgcatcttcgaatgggaacagtgactcacactggggcccaaacactccaggccaaacaccccaggtgtcaccaatgcctccacccaatctgcattctcaggcagtgacaggagggtggcattcattgctctaaagcaattgccgggtgcattccaggcttaaggacacagactttcaagaagtcctatgctgggccgagtacagtggctcacacctgtaatcccagcactttggaaggccaagacaggcggatcacttgaggtcagaagttctagaccagcctggcaaacatggtgaaaccctgtctctattcaaaatacaaaaattagccaagcatggtagcacacacttgtaatcccagctactcgggaggctgaggcaggaggatcacctgaacccaggaggcggaggctgcagtgagccaagacctcaccactgcactccagcctgggcaacagagtcagaccttgtctcaaaaaaggaaaagaagtcctatgctggatgtcaggggtacaggcatggaaaggggctgcccattcggaagctctctctgtaggatgtggacagggcagggcaacccaacaccagacctgcctgacctgaaaggctggaagaggcacattgaaagtttgaccccctccttccaaccactccattaaagtcctacaggggctttcccagccctgctcaccttggcacccagattcccaggtgtggctgccctgccagcctgaagcacagcacagtggcctccccctcaaacatgccattcagcccttctggtcttccctcagctcttgtcgccagccctgcctgcccacacactgtccctgctcccgggaaccccctcccaatctcaatgccaagtctcagctaaaaagccacttcccctggatccctccccgttgcccacgccttgctcccacgacacatgtgcttcccatctctacactcattgcacttgcacaggcttgctccccttgaggtgcccgttccctggagccgctcacctgtcctgtccctgggctgccttcctgttcagtgctgggcaccaagcaggcacttcacaaagatttggggaattcaactgaacggaggcacagagcagcatggtggtgcagacaacaacgggtgacttcagggagctagttcaagtcctagctctgccacggtgcggggacctcacttccttgtctacactgcaggggcggaccggcccacccacaggcccctcctacctctaacactcaaaagaataaggcaggggaatggacatctgttggcttgcttgactctgagctaggattttatggtgaggctggtcgcagcggtggcacagtctagcatttatcgatggtggtccccaggccctgtcctcggtgctggagacaaaggacaacaatgaggctcttgttctgaaggccctcagcctgaatcctagcatcccaaagcatcccccaccacctgcttctcactttcccctggggcccctctctgcccaggaggctccggccaacgtcatccagaggagagaaaaagccagaaagcaaaatccaagggtcccgcccagtaacagctttcgaggtgggcctgggaagttcaagccaaagagaatccatcttagaatactcccttgccacctccagagaggaaggtggtggagaaaaggccgcgctgcgccatccaggaggatgggtgtctgcgcccggaaaggcctttgaataaacccatgatatacattttccaagcagttgtctgcaaacgcttcacggcttctggcccatagattccagcttttggagacgaggcctcaaaaactggcaacgcgcaagccgcatctgcccatgggtatgttttgtttggtaggcaaggttttaaatttttttttaattagttccaacatttaaaaatcatctggtttcacgtaaggatccaaatgtccagcttctttagaaaaacaggcggtactaggtggaatataagacatgccttgggaagaaagtccaccagggtcgcagggcaagcaaagatctaggagatcaccatcagtaagctggcggagacggaacctgaagcaggggaagcccagacagccacaggccctgaaccaccagctgcagcctgtgcaggcagacagaacgtccttagctggccccagtccccaacactccctccagcctcacaccaggagcctccttcattcacatgacttactggctcctgcaggcatttagccagcagcctcttagaaagatacagggccaggcctcataaacccacccagggcacaggcctccttccccataatctcatctaccctccctcatacccaaccagctgacactgggaatgaaggcaaagaggacacatctacccaggagaacaatcagaggctttctctgcaggatgctcgccaactatgggacgctcagtacgatacactgaataattgacaatccctctgatgcaccttgtgcttttatcattacacatctgcgtatcgttttaccacgtccaaaatgctaacatgtcaaaatgtggggaaaacatcctcataacttattcatgaagaaaaaaattctatgcaatgaggaactctaagtgacataaattgttatttttattttaaatattggtccatttgaacagctccatttaaaaatggattaactcacccttttaaaaatgattaatatttgatcaacacaagatacctaatctgaagcttaaatcttcccccaaaactaatatgaatcaggtttctttaggcaacttcagaatctattggaaaggcagttgtaactttataagggaaaaaaattatcagagtggaggaaatacctgcgtcttatcttgcattttcttaaaatcttcacatgctagccaaaacaaaacattttcttcactgaattccttttttaaaaattcctgtggatacaaagaaaaagagtcacacagtattctactttaaaaaaaaaataaaacaaatggcatttcccttcaaagactgatttggcaaaattcaacagaggagcatggttcagttactcttcgaaaaccccactctgaaaaacaaatgagtatgtttaatgttaaagctataatttcatatgcatttgaccttaatggttttgacattgtaaagaagagtacaaatgaagcaggaatgtactcatatttctaagctgacaataaattaccaaaaagtaaattaaagtggaagatatattggttccttccagacagtgtttaaacaaagtacattcctctaaaatcaggctgttttttaaacaaaagaaaagaaagcacattaagtatgtctaaagacaccatgatacaaactattttaagttggaggtatgtgtgttttcttatggccgatcttgggcagtccatggcacagccagctactctgctgtgcagagacctcctgagttgcaaacactgctcacagtggcctggcgaccaggaactagaagcctagtaccacctgccactccctccctgggagctccaacaggcaccaactgcatgaggactcatcctattcctgacccaagacttaaagacagaagtaaccaggactcattcttgaaattcacatatggtcctccatctggcaccgggggcttctgctggtcagaaaagctatttctagatgggatcaacagttccccatccatcagccctgctctcggaggtcccttcgccaagttctcattgccagcctctcttactctgtcaacaatgcattctgagaatcccccaagcacgagagaacaagccttcacgtcagagagacccagagctgggaattcctcatacagactccaccaataggcacggtatcttctctctcctcccaccctgtacccctcccacctcactacacaaaaaccagaaacaggctacccatctgtgacagcgttgccaacacagtcatgacagatgagaaagtctcaccctcaagctgggatagacagtactgaactctcaagctggcatagagagtgctacgctgacagacaatgttgaactggcctatttctcccctgtgtgcatctgaacttctgcacacactgcatccatcccgattaacaatgaaaaagacaaaccctaaatcttttcacgccttctgggtcttccagcagattctccagggatgccgcccatttggctgtgctcttgaggctctggtggctgctgctggaactgccatcgctgtcgtggatgtctgcaaagcaaagttcagactgcatatgtggccaacagacactgtcattttaagaaatctgcatgcaatggtcagcactgccgtcaccatcacggctgacatacaccgacttatgcgtcaggctctgttctaggtgcttaacatgatggactcattcttgtcacacaaccctgtaaggcaggcactactatttcctccattttacagatgggggtaaactgaggctcggagggatgaagggacctgctgtttcccaccaaatccttcccctactcttgtgtccactggccaattcagaggcagccctcaagtcacactcaaaccctcctccaagagaaccttgattcaacagcaactgcttccccatggcgctttgtgcacagacttagaattatggtgctgtgttgtgactatttacatgactgactcccactagtctgaaggctcctatgtgtcctcatcttgtatctccagcacctagctcattatctggcacagagattaaaaaactcattgcaggacgggacccacgtgatggcgcaaaatgtcagagggttgccagaatacccaggcatcaagataaatgtcatttcaggcaatagctctttttgtttgtttgtttgtttttgacagagtcactctgtttcccagtctggagtgcagtagcacagtctcggctcactgcaacctctgcctcctagattcaagcgattctcctgcctcagcctcccaagtagctgagattataggtgattcccaccgcacccagctaatttttgtattcttaatagagacggggttttaccatgttggccaggctggtctcgaactcttgacctcaggtgatccacccacctcggcctcccaaagtgctgggattacatgcatgagccaccgcgcccagttcctcaggcaatactttttcaaaaaatcaaaatttatgctaaaaaatccatgatgaacaaaatacccaaattttaaataaagacaggatcggttatgctgatttttccttttgcttcagagtccaatatggctcagcatcacactgttatttttcctgactttatttaaacttcggatatttgttcattacggatgtttctgcattaattttgatcttttaaaacactgcattaaatatcatttataggctgggtgcagtggctcacacttgtaatcccagcactttgggaggccaaggcaggcagatcaccagaggtcaggagtgaaacctcatctctactaaaaatataaaaattagttgggtgtggtggcatgcacctgtaatcccagctccttgagaggctgaggcaggagaaacgcttgaacccaggaagcggaggttgcagtgagccaagatcacaccactgcactccagcctgggcgacagagcaagattccatctaaaaataatgataataaataaataaataaataaataaataaatatcattatcctgatgcctgaggtttttggcaaccctcttacattttggtgcacagagaaaatggatgaaaactctttgcatctgcacatcttccactgtactctctgactcacgacactgagaagtctcctgggaggaacagggaatctccaaataacacactttggccacttgcctgtaggaggagggaacaattaaagcatgcttcattctatggcatgtgatcccttcctggagtcaaggaagaaccatggaatgtcacttcagatggggccaggttcaaaacccagtttctggccgggcacggtggctcacgcctgtaatcctagcactttagggggctgaggcgggtggatcacttgaggtcaggagttcaagaccagcttggccaacatggtgaaaccccgtctgtactaaaaataaaaaaaagtagctgggtgtggtggtgggtgcctgtagtcccagctacttgggaggctgaggcaggggaatcatttgaacctgggaggcggaggttgcagtgagccaagatcgtgccactgcactctagtctgggtgacaagagcgaaactctgactcaaacgaaacaaaacaaaacaaaacaaaaaacccagtttccccaattcaaaactataggatcttgggcaaaattcttgtgtatatttgaaaatcatcccccatctcttgggttatcataaggattcaaaaatggaagcacatcaggcacctagcagcacacttgggacacagtagatgctcaacaaatgtgagctcctttcttcccatctctaaaataaccatctatcaagcaaactacttctataactaacacttttttccccattgactttttttctttccaaagctagagacatgtttctataaaaaaaagttcaaatctaggagaaaataaacttttaattaagaaatcagcaaggccgggcgaggtggctcactcctgtaatcccagcactttgggaggccgaggcaggcagattgcaaggtcaagagatcgagaccatcatggccaacatggtgaaaccctgtctctactaaaaatacaaaaatttgctgggcatggtggtggatgtctgtaatcccagctaccagggaggctaaggcaggcgaactgcttgaacccgggaggcggaggttgcagtgagctgagattgcaccactgcactccagcctggtgacagagcgagactccatctgattaaataaatacataaataaatcagcacagcaaaccacctctaaatgatatatttttttaaataaagtctcataaatattaattgctgcaaacagctagggggccacacagctaaaaatggttttggagaaaatctgtatcagagcacactggacttacttaatagtaacagctcctgtgatctctgatgttctatggggggtcaaaatacatgttgacttcttgatcccctgggactccaaatccaagcacctggggaaactaccaggattttagacattcaccagatgacatgagctaaattagaaccaggccagctgggcacagtggctcatgcctgtaatccaaacaccttgggaggctgagacaggaggatggcttgatctcaggagttcaagaccagcctgagcaacatactgggaccccatctctataaaatatttaaaaactaggctgggcacggtggttcacacctataaccccagcactttgggaggcccaggtgggcagatcactcaagctcaggtgttcgagaccagcctgggcaacatagtgaaatcctgtgtgtacaaaaaatacaaaacttagctgggcatagtggcatgtgcctttagtcccagctatttgacagactgaggcaggaggatagcttgagcccaggagttcaaggctgcagtgatccatgattgggccactgtactccagcctggatgacagcaagaccctgtctcaatcaatcaatcatcaataaagcagaaacccagaaacccagcagggaccatgcttcaatgctcattggcaatagagtacgtaagagaattatttgggacaaatcctttcctctaaccatgaaggaaactcacttaaacacatcaccaaatggagctgatgcttttctaaagtgaccctccagttcgtggatattaaattagttccctgttctctttgtaaatgctgcagtggcaagttcctgaacactgagtttctttccaacaaagtataaatccaattaaaagatcattattacaagaaatttctgcagcagggttcattctgccaagcattccactaatttactcttctgctctttgcccagagaatacagtttgacagtttactccatttccccagcagatcttctcttaagtaaataaatctagagacacaagttcactgttccaggaacaatctaggcagctgcaaatttctcttgccatggcagaaccactttggccataagttttcaaccttggtctgaaaggattccaaaactcttgacattcttttccataataaaccagaccatgtttgggttttcactgccacgctgtcttgcaaataaatacacacagtagattaccatttagccaacaaaatgtctgagagttaaaagaactgacctcactgttagacaattgccaacccccaccctttatttcatactctaatcatttttgcatattaggtttatgtgttcaaatgtgttttcatttgaacaaaaaattttacaactcaaaacacactaatgtggtccaggcccacctcccccaccacctcattttatagactgggaagcaaaaatccagaagatagaatgacctatccaaggtgatgcagctaatgaatcactggatggacccaatactgggacctgtatgggaggtcagctgtcctcaccagggccatgtctgcagaatcccagggctcctgggaacatagttagaaaaccgatgggcccttccattccatggtctcctgggctaagatctcccttatatcatatgccatgaaatacgttaacaattgacactattacagaagagcatggagttttcagggacgggtcagaaagtatgccaagatggagctgctttttatagccatgggtattggttttctggctatggtgctctagataaagagcaattccttcttgcctttttgctcaccttctgtccccataagtggaatagaagatccttctatctgagatacctgctctctatctgtcataagtttttattttccccaaaaatgttggtttgaatttttctaagacttcctgactgtctttcaagtttaaggcttttggctatggcaccccacccttttcaaatccatcttgactgatatcagtatagacagatcttgatgagacagcatttgcaaactccactcacccagtggcatctctcttttccaagtcactatccccagcctccaatatgactgagcagacagggatagcccttaggctgagggcacttctgcaactcagggtcccctgctcaggggacacactaagtaatga

SEQ ID NO: 37 - DNA, 165213 bp, Artificial Sequence
  Synthetic BAC sequence
ggactactgagtgctaagttctggaccttttgcagggccttcaaggaacttactgtctgggagggaaaggaagacacaggcatagagaaaatgtgccaagccatatgaaagggcacagggtaaaagctctaagcccacctcatcactgacagctgttcaatgaggtcagtcaggaaggactgtttcccagcaatacaaaaattccaaaattaaatttaaacagttaaatccctgggttttgctcattcttcttacatatgtccaactctccgggcttcctccatggtttccaggtggcacataacatgttcactgaaagctccagctctggacccagagagacctgggattgaatgccggctctgccacttactagattgtgtgaccttgggcaagtcacttaactctgagtctgtttcctcaactaataaactgatctaacaacagcagctgcctgatttgctgatgggagaaatgtaaagctctgagcacctgcttggcaagaggacctttggccccaagaggaaggaggttttctgcagaagtagacaactcctcgctcaccaagggaagcaggagagtgagagaggctggtgcagatggcccctgagaggcggaggtgggaccacctctgctactttctctttccctttgctggtggtccagtgtctactgctgccttcgcaattgaaaagcccgatccccagccgggtatggtggctcacacctgtaatctcagcattttgggaggccgaggagggcggatcatgaagtcgggagatcaagaccatcctggctaacatggtgaaacttgtctctactaaaaatacaaaaaattagctgggcatggtggcacatgtctgtagtcccagttacttgggaggttgaggcagcagaatcgcttgaacccaggaggcggaggttgcagtgaaccgagatcatgccactgcactccagcctgggcaacagagtaagactctgtctcaaaaaagaaaaaagaaaagcccgatccctgtcttggtcctgcccataccaggccccccctcgggtgagtctctgagcctcgacttccccagtggtaacaaggctggagtgcagcaggaccctgggagccgcagccctgctgtgctgcctgacaccccaccaaaccctgagggaaatactcatatgtccccatatgatatggtttggctgtatcctcacccaaatctcatcttgaattcccacatgttgtgggaggaacccggcaggaagtaattgaatcatgggggcagatccttcctgtgctgttctcctgatagtaagatctggggttattatgagggggagtctccctgcacaagccccctctttgcctgctgccatccatgtaagatgtgactttgctcttcctcgccttctgccatgattgtgaggcttccccagccacgtagatctttgtaaattgcccagtctagggcatcagcagcatgagtacagactaatacatcatatttggaggggctcggacagggcctggagggcacacaccccatatcagtgagagaaccaagtggcagtgggggagaaatatcacctacagccagatttgcttccttctgggaagcacccgggaggcattttggggtgggggatggcatgactgggctggaggtaacctgggcatccccaagcctctcaaagcccttcatcccctccccatggcctcctacctgtaatcctagcactttgggaagctgtgacaggaggatcactttagcccaagagtttaagaccagcctgagcaacatagtgagaccctatttctaaaaaataaaatttgtttaattagctgggcatggtgttgcatgcctatggtcccagctacttaggagattcaactctacctactttatagaaagagaaatgcctgtcttaatggtccagacaattgcatgttccatcccacacggggagcatatttcccctaagtgagtataagctggagatgtgagtccagtcggctgctctcaactgccccgcttggtgaaaacatcccaccactgcatgtcattctgatgtttacccatacgtattcttcacccagcctgggccctccacagagaccaacgactgggcgaggcccttgccctaagacccaagaatctgtcccctgagcccgggaggtggagggaaaccagccgtgccagtctgcaccatagtgtttgcctagggtatgtccaagggaaattttggtgaagcaaggtacatgcccgatgcaaggccttagaacctcagcccatgaggaaggagctcctctgtcctttagccaggagtggtcggagcagggagaaggagtggtgaggctcttggaagtgggacctccatggcttgagaataaagtttgttcctagccgacctaacgtcaccatcaggctggccctcaccttgcccataaggagaataaaccagtactaccagtgtgcctgcttggaggttcttgggtgagtatcttgggcatttccagaggcagccacccccactctacccaaccctcactgaggctttagggccctccccacctgacgaccttaagcctctgatgaaataaaaagtatacagtttctccttagaaaagttggggcccctgaacttgatgcccactgtttccccaacatatgagtggtaagaagtaatagagaacaatcctctgtgcccttcacccagttccctgcacaggcaacatctcaccaaactctggtccaacaccacgtgtacagaaccaggatgctgacacggacactcaacacacggagcacgtccatcaccacgagggtccctcctgttgctgtttcatgaccacgctcactttcctcctgcccccactgcctccttaacccctggtgccagtaatcggttctgtattcctaaaattttgtcatttcaagaatgcccttgaatcccatctctacaaaaagtacaaaaaattagccaggcatagtggcgtgtgcctgtggtcccagttacttgggaggctgaggtgggaggatcatttgagcccaggaggtcaaggctgcagtgagcatgattgtgtcactgcactcctgtctgggcaacagagttgagaccctgtctcaaaaagaaaaaaagaaaaagaaaaaaaaagaaaagaaaagaaaagaaaactcttgaaatggaatcatgtgatgtgtaccctgtaaggattgtcttttttttcactcagcatctttctctggagatttaccaggtgtttgcacatgacaataacacgttcctttttattgctgtgtagtattcatggaacggatggacacaacttgtgtaaccattaatgtggtgaaggacatcagagttgttccaagtttttggctctaacaaataaagctgctgtgagcttttgcgtacagggttttgtgttgttggggccaagggaacttcccctttgtcctctgaaggtcctctggaaaatcaactcacaaaaggcagattcattggagaaaaggcgtacaaatttacttgatcatagttttatgggacatgggagccatcagaatagagacccaacacccaggagagtgcagaagcttagacattgtcctgaggttacagaaagaatggaggctcggatgctggcaaagcaggttgtaggaagggagagaggaggaactttgctgagggccaataaaggattcctatggagaattcaatgggcttgaggaacataaaagcatctggggcaaagtctgttgggcctgcagagcggacaatggtttgtgacaaaagtctgcccaggtttgttaaaagagaattccttccttgcaatatgggtttagttcatgaaaactcagagaaaggatcagaaggcattgttttcttcttaggtaggtctggacttcaggcagataaggaaacttcagagaatccaatgctttggagaacagttgggctggggcagtcagagagaccttgaaactcctttttcagttcagcatgtccaacatgccatattttgaaacatccgcttctgaaccccaacaatgtgaacgtatatcttcatttttccttccttccctccttccttccttccttccttccttccccctccctccctccctctctctctctctttttctttttctttctttctttctttctttctttctttctttctttctttctttctttctttctttctttccttctttctttctttctttccttctttctttcttctttttatttcttctttcgagacagggtctttcactgtcgcccaggctggcgtgcagtggcgcaataatatctcactgcagtcttgatcttctgtgctcaagtgctcctcccaccttagcctcctgagtagcttgggaccacaggtgtgtgccaccatgcccagctaatatttttttctttttttttttcttttgtggagatggggtctcatcatgttgctcaggctggtctcgaactcctgcctgagctcaagtgatccacctgcctcagcctcccaaagtgctgggattacaggcatgagccactgttgcctgcccatatatcttcatttctttggaataaatggaaagcaaccattgggtcgcatggtagttgtatgttcaggttttaaagaaactgtgaacatattttccagagtggctctaccatttcatgttcccaccagcagtgtaagagtgatccagtttttccaaatcctcaccagcattggatgttgtccctgttttttattttagccattctgatagatgtgcatcactgtggtttcaatttgcatttccctaatggctaatgatgttgaacatcttttcacaggctcagttccatttgcatatcctcctcaatgaggtgtctcttcatgtctcttgcccattttcaaattcgattgtttggcttgttgtttgagagtttgagagttttttaccctctctagatattagtccttattgctaaatttgttgtggtgagtggttgaagccttcgagccctgttctgcagttttccttatgagtataatacacacacatctggcttcataaaaggcagggtgcctccccagagagggagctgggcaggttgacggtgctgggtcactccagctgagatcatttgcaagcctgtcttttacagcccttggttctcttcaaaccccatgggcatattgtgtctctggctcccagttcttcccaccacctttcctataggtggcttcatcctacacactttggagatggtcatgataccttgatgatgacagagggcttgcacttctccctacaatgccatagatctagcccattccttaaaccgtctcaaaaaggcacctccagcccttttaacctttgatgccgtaccctgtcctgttgttctttgccacagattccagattcctatagatccgtgtcactcattgtgaatcaaagctattctgcaggacacagaataaatggcagaaagggaggtcactggaaagcttcatgtagaatcatagctcagggcaggacagcctgtgtgctgcacgcttggccacaccagccaacggttaaagaagtcagcactgcaggggatgccccagagagggtgagcaggaaattgcaatctacatagacccaaaggtgcagaggaaaggtcacaggaccgggcatcagagccccctgctcactgcaggtctctctgtgtgtgtggcaggggcgtggcggggggagaggaacaggtgtcacatgacctctgtccctaagcatctgaactgaagaagtaaagaggtcagccagcctcctcccactccagacctctgggatacttaaagtaagtgttgcagggtttgtagcatcttggaacctttcttcctacatcacagaaaaaaaaaaaaaaaagtccagtgaaccggttccacctcttaagaaactgtggtttctacagcctgaacttgagcaaaactggaacatcagaaaattatttcctcctgccccatctctgatgtaatagcagatccagtcctcagctctgtttctatagagaaagctgggtgaacgggatgggtctttattgagttccctttgacgttcttccaaaaaatagatgtgattttcccctctccctccctctgtctccttccatcatccttgcctcctttggacccatagaagggggttcttgtgggaagtgatgatctctgagccaggccctctttcagatgagctatgaagttagtttgtttacttatttttttcatctaaaccccaaataccacagaaccagcacctgcaatttttcctaacacatcctttgaacttgctgcaagttaaactgtagaggtttcatttctcagttgtaattcagggtgtcttccccatgccatttgcttccaaggagcaacatcttcctccctttctaccccaactcccatcaacaactgaaaaaaacgagaaatcagaacttcagccacagcagcctttcctggctctgtgtgaacaccgtggagaggatacagcccttgactccctggccctcctccctctcacgtctaagctgggaacaccataaacagtcacagtgctgagccaggcagagaggcagacgggtacagccagacgggacagatgtaattagcagcatcattgctttggtgtgcagaatagatagcagaatgccgccacccacatgatgctttggcaaatgtactgtcgctcattttcacaaacaattcaataggtcttttaaaagtgccgacaacaagcaaagaaagtcacggaaagaaaccagagtgacaactcagcccgagtgccaaagttacttgagagctgctctgggaacagtgaagccaaaccaactccgagttcaatctgatccaagttcagatggacagagcctggcatccatggggcaagcagtggtgcccgattcatcgtcagataaagtgagctcagatgccaccgtgttcctgatgtagctgtcacatgatgcctctgagtcgtactttttccatctgcttaatgggcatgttgatcctggtgtgtgtatttctagacttgctgtgaggctggcgggaggccacttggaagggaaagtctttgtgatctacacagtgggggtcgtcattaaggaagagcctcaggaattgcagccacaaggacagtgccattcctaaggtaaatcacgggaagaagaagcctcttaaccccacctcctacagcagcgagcattaactcctccccagtggcaattccccaggcctctctcctcatgaagcccaaggatcaatgaagtaactcttacattctccagcacccacatggtccagtctcgagccattgtgcagctggagaagcacagtccagtgtgtttttcttctgtttccccagcactctgaaggagagcccaacaccaagttctaataatttattaatttttttatttttaatgcatttttattttattttattttattttattttattttattttattttattttattttagaaggagtcactctgttgcccaggctggagtgcagtggtgcaatctcagctcactgcaacctctgcctcctgggttcaagcaattctcttgcctcagcctcctgagtagctgggattacaggcatgtgccaccacacccagctaattttttgtatttttagtagagacagggtttcaccatgttggccaggctggtttcgaactcctgacctcaagtgatccacccacctcggcctcccaaagtgttgggattataggtgtaagccactgcgcttggcctttatttttatttttaaaagacagggtctcactttgtcatccaggctggagtgcagtggtgtaatcatggctcactgcagcctcaaactcccaggctcagacaatcctcccactacttagcctcccaagtaactgggactagaggcatgtgccttcatgcccagctaattttttattttttgtagagatgggggtctcacactgttgcccaggctggtctcaaactcttgggctcaagcaatcctctcacctcagactcccaaagtgctgggattacaggtgtgagacattgtacctggtttgggagcctattaaaatcctcatttctctcctatccatgtctctcaccctggcagccaccctggcacccccttcacttctcccttccctcttctgccccttcctgtatcatgtagctttgcctggcattttttccatgggcggagatgatgtaagccagctggcaatgacggggttttcaaaggcagctggtaacagaggaaggctcgcagactaatacttattaccccactgccattgtttcatttaatgttgtcctcaaagctctcctgggttcaaacttaaaacccatgcaagtgtcaaaacaaatcgtgcctttttgagtatttttttctctcctggatcttcctttcaagcttgtttcctaccttccctccgggtgaaaatgaagatttgagttcctattttctttctttttttttttttttttgagacggagttttgctctcattgcccagggctggagtgcagtggcgtgacattggctcactgcaacctccacctcccaggttcaagcgattctcctgcctcagcctcccgagtagctgagattacaggtgcctaccactacgcttggctaatttttgtatttttagtagagatggggtttcactatgttggccagtatggcctcgaactcctgacctcaggtgatccacctgcctcggcctcccaaactgccgagattacaggtgtgagccaccgcacccacccgatttcctatctttcttgagaagcatcttccaaaacgtaaatgcacagactctcagagctgaaggaagcctcagggtccagctagtccaatccccggtgatgtctgaattccccttacaacatcctggcaggtgaccacccagcctctgctcgaatgcctcttgggagcaggaaccccccttctaccccctgaggctgagcagaccatgtttgatttttttccaagaaaatcttccccaaagggcaccttagccttcccatcccacaaactcaactcccagtggtcagtggtggtgttgggaggtcgaaggaggtggcacagaagtgtccacaccatccctggtgtacagcaggtgcccaaaatgtttaagcagatgaacgttctcgaggaaaatgatttaaacttgatcaaccagttactttcaagaagggagctccatgagtgtggaggcaactgggacacacgctgctcaccgggactgccaacaaaaactgggtgcaggatgtggctctgccggcacctcacacccggggacctgagcaactcactcggcctgtgaccccacctcttcacctggacagtggggctgacggtccctgctctgtgggcccacaggccattttcagttttagtggaaataatgtatatgtgaactggaaaggacttgataaacataagggttattcttattattcttcctattattaaggaataaagaccacagaacagtcccaacgtctccatttataatcttatttatttatttatttatttatttatttatttatttttgagacaaggtctcgctctgttgaccaggctggagtacagtggcgtgatcatggctcactgcagccttgacctcctgggctcaagcaattctcctgcctcagtctcccaaatagctgggactacagacgtatgccaccacaaccagctaatttttgtagagatggcatcttactctattgctaggactggtcccaaattctagggctcaagcaatcctcctgcctcggcctcccaaaatgttgggattgtgggtgtgagccaccgcacctggcctcaatttataattttaataattctccaaggagatattgatttttcatagaaaaagagcccaaactcctcctacctatcaagacttggggaaaatggcctcatttgacatgtgtagggtggagtagggaatacaaattagtatcactccatatccctgaaaaactgcagtaacaccgttaaacccaccctggcagcaagtcgtgccctgaagatgcgttgcttattcctctcccctctcagctgctggaggaacttgagggcagggctgggcttgctcctctctgggtcgggcacagcctggagctcagtgactgtcacacgagaagtcctaggccagcaagtatgggagttggtgaggggcattcagtggccactgaaatgaatctctcattggcggttgagcccttcttttcctgctttttcccattttcttccctgagagtggactctgttgatatgctttggctctgtgtccccacccaaatctcatcccaaattgtagtccccacgtctcaagggagggacctgtaatcctcacgtgtggagggagggaggtgattggatcatgggggtggtttcccccatgctgttctcgggatagtgagtcctcacgacatctgatggttttttaagtgtttggcagttcctccttcacacgctcttctctctctcctgccaccatgtaagatgtgcttgcttcccctttggccatgattgtgcatttcctgaggccttcccagccatgtagtactgggagtcaattaaacatttttcctttataaattacccagtttctggtatttctttatagcagtgtaagaatggactagtacatctgtcaaagaggatttgtcctaacgcatatgaggacattgagtatgagacattttacagttcattggtgtttgccctgaaactccaatggccccttattccccgacaagatttatctggggtgtgcttgatggaaaggttccagggcctgaggctgggggctcctgaccaagaaaggggctttgaggaggacagagcactggactgggagtccaaagacagtcctcattccatcctgtcagcttgggtatccccattccccctcagcctgcttcctatctatgccaggagggctgaccagggctgctcccaaagatctcacccacctctgcggtcattaaactgatggtgaaagtccttgaggtggcctgaggggtaataacttgtaaagtcagacgtccatgggtggaacagagcagagacggccacggaactcggagggtgtaaacagctccaggcacccaagccaagtcaggcactggcagagagtttggcatctattttctaatagctaagggaaataaaaaaaaaaaagcaaaaaaaacttgcggagttatatatttcctgtggaatgaaacattctcaaagatctacttcctggatccgtacttgcccgcctctaacagagccacgaataaggtctctgaccactggagacacgacaatggcactcagccaggtggcctatcagtcgtcacggagaataaaggcactgtctctactcagactgtaggaaggctggcctccagggccctttatgttccttttttttttttttgagatggagtcttgctctgtcacccaggctgcaatgcagtggcgcaaccttggttcactgcaacctctgcctcccgagttcaagtaattctcctgtctcagcctcctaagtagctgggattagaggcgcctgccaccacacctggctaatttttgtatttttagtagagataaggtttcgctatgttggccaggctggtctcaaactcctgacctcaagtgatccacctgccttggcctcccaaagtgttaggattacaggcgtgagccaccgtgcctggccccctttacattctgaagacctaactgaatgcagcccgagagcctgggtgtctatcagtgtttcccaaagcattgttgtgcatggctttgaacacacaaaacatggagtgttcaaaccctgcacattccatagactggtctggcccttgatgggatcctaggagatgacctctaggccctcagaaaatccagcccaatcagactgtctttacatgctgaggcctgggccatgccagatagtttatgcaggcagtgtggtttatggttggagacatgggccatatggtatcagtttaacctctggaggggctagagactgagtcactaagatcagccatatggatgttccacacctatgtgaatgatcctcaatttaaaaaaaaaaaaagccgggcgcaatggctcacgctgtaatcgcagcactttgggaggccaaggtgggcggatcatgaggtcaggagatagaaaccagcctggctaacacggtgaaacactgtctctactaaaaatacaaaaaaaaaattcgttgggcacggtggcaggcatctgtattcccagctactcgggaggctgaggcaggagaattgcttaaacccaggaggtggaggttgccgtgagccaagatcgcaccactgcactccagcctgggcgacagagagagactctgtctcaaaaaaaaaaaaccctggacaccaagacttcgttgcacttccctggttgcttcatgtatgttgcctcccactgctcctgggagaagtaagtgccgttcacatgactccactgggcgaggacaattggaagccgtgcctgtctatgcacctttgctggtttgaatctggatcctttctgagtataactcagagcttttctgagttctgtgagtcctgttagcaaatcagggaacctgagagtggtcttggggacctccccccaactcaatggtctttggataactttgacaacctactctatcagtttttctgagacagagcctggagtgctcattttattaagtttctcagatgtttctgaagcatagcaaagttaagaatcactgcttgagagaaggaagtggtgttttctgtttgtttagttgagacaaatatatgtgtgtttgctttgccttcaattagcttgtaacccttacaaccggaattaccaaacattgcacttgtactgtggtccccaaactgtccatccaggcacccagatgccacagcaaactcacaggcatgccatcgaatattttattttattttattttatttatttggagacagactctcgcactgtcacccaggctagagtgcagtggtgcaatctcggctcactgcaacctcagcctcccaggttcaagagattctcctgcctcagcctcctgagtagctgggactacaggcgccggttaccacgcccagctaatttttgtatttttagtggagacagggtttcaccacattggctaggctggtcttgaactcctgaccttaggtgatccaccctgctaggcctcccaaaatgctgggattacaggcgtgagccagagcgcccaggctgaatattttaaatcttcaatggctagatagcagtcattaacaatgtgtgaaccagctccaggtagttcacagtttcaaagcttggtcatgctaccttccttttgatggaatcatatcttcgcacagctgggttttcggtgattgctgtgataaaaagtaagtaccacacaaaaatcaatgggtacttgtgtgggacaggaaatcagggtggtgatgtcaatctgattccaaggtctgggaagctgcgtgatttccatgagcatacacacctcagtagtgagcagctttggttgttttacactgaaatagaaatgctcttttttctttcaatttatgtatgcattttttcccaatggctgctaatatttattaaattaggacacaaatacttataaagttgtttggacctaatcacttaatatatggaattgttcgattttgtttgatcgaaggacaccatgaaaaaattactgagacactaaggatatcatgaactgaaaaaattcaggaacctttggactaatgggaagggtcagcataagtaatattgtttccttctcagaagtgaaggaaatacaagttaaaggacaccaagaagaaacaataaaacaaatccagaacatgggtcgttttacactaatacttggcctagtgtcttcaaaatggtattgccactacattaaaaatagattgaagattggtctacattgagagatattacaatgccaacttttttttattggatcctggtttttagaagtacatttcaggtcaggtgtggtggttcatgcctgtaatcccagcactttgggaggccaaggtaggctgatcacttgaggtcaagagtttgagaccagcgtggccaacatggtaaaaccccgtctctactaaaaatacaaaaattagctgtgcctggtggcccacgcctgtaatcccagctacttgggaggctgaggcacgagaatcgtttgagcccaagaggtggatgttgcagtgagccgagatcactccactgcactccagcctgggtgacagagcaagactctgtctcaaaataaataaacaaataatttttttaaaaaaggacatttcaaaatgttctatagcttgggaagtttgaatatggagtaggtattagatgatattgggaattattgttcattttattaggtgtactaaatgtccttgttttaggtgaagcattatgtctgattttctttaaaatagtttgccagcaaaacatgagcagagaaatgaatcatggcaaagtgttcattattaagtcaaggtaatgtttttgttatggttgtgtttttacttttcggaatattttgaaattgtcctaatacaaagtttgttaaaagtgatgggttagtggtaaactgagcaaaatgatttgcactgaataggcaggaatataaaaatatggacaactccactgaaactcctcccaactctgccacagaatcggacataggcaaaatggcaccttggctgctgaaggttttgtgaagtagccaatctccctaatgggaaaaatcagaatacaacctcaaaaagctcatgcatggaggaggaggggccaccttcttctcactccacatggctggacgaggagttgaggacagagtgtgtggattatccatctgctgagaactgagacaccagagctgggcgtcaggatgacagcacagtgagaggcccaggaccctcgataccccatccccagcatcaccacagctcctggctcacgtcgaatgttccacctgggtggacttctcaaggagatgcttgctatgatcagaatgtttgtgtcctcacccccaaattcatgttgaaactaaaagccaaagcaaaagtattaagaggtagggcctttgggaggtcatgaggctggagacttcgccagtgaaattcgtgcccttatcaaagaggccccagaaagctgcctcaccccttctaccatgtgaggacacagggagaagacgtccatctgtgaaggaagctggtccttgccagaccctgaatctgccagcaccctggtcatggacttcccagcttccagactgtgagaaatgtctgttgcttctaagccattcagtctaaggtattttgttaccgcagcccaaatagacaaacacagtgttccttaaaaactgccaggcacagcggctcacgcctgtaatcccaacactttgggaggctgaggtgggtggatcacccgaggttaggagttcaagaccagcctggccaacatggtgaaaccccgcctctactaaaaatacaaaaattagctgggcgtggtggcatgtgcctgtagtcccagctactcaggaggctgaggcaggagaatcgcttgaagctgggaggcagaggttgcagtgagccaagatcacaccattgcacttcaacctgggtgacagtgagactctatctcaaaaaacaaaaacaaacaaacaaaaaaacactgcatcccaggctgggtgcagcagctcatgcctctaatcccagccctttgggaggccgaggcggcagatcacttgaggtcaggagttacttgggaggctgaggcaggagaatcacttgaacttgggaggcagaggttgcagtgagccgagatcgggccattgcactctagtctgggcgacagagtgagactctgtctcaaaaaaaacaaaaaacaacaacaaaaaaaactctgcaccccagatgctagaaatattccatagccgaatgcggtggtagttatgagtgtgtagacaaatggagacatccatagagctctccacttaagatttgtgtactttactctttactgaaattaggtacgtcttagtttttttaaaaaaaattccttccaccaaaaaaaaaaaaaaaaaaaaaaagaagaagaaaaaatgcatcccagtgagctggggaggaaagagtgaaattgtagctgcttatctgggaagcttcagaaataaaacattttggaacgaccaccccgaggtagaagacgaggatttggaaatacacttttaaaataaagtgatgggaggctgggtgcagtgcttcacacctgtaatcccatcactttgggaggctgagtcgggtggatcacctgaggtcaggagtttgagaccagcctagccaacaagatgaaaccccatctgtactaaaaatacaaaaattagccaggcatggtggcatgcgcctataatcccagctacttgggaggctgaggcatgagaacccaggagatggaggtcgcagtgagccaagatcatgccactgcactccagcctgggtgacagagcaagactctgtctcaaaaataaaaataaaataaagtggtgggaaagagagacgtttagtatctcagccacactaaacctttaagcctctgtgcacacagccagtcatttcttgatctctttgttaatataactttagtatcaggcagtttgttgtacaaagtcctgcagttcttcaagtaataaactcacatcaaaacactgtttccgagcattaaaaaaatatatagcattgatttaaaaaatgaatgaactgaacaaaggtctcccactaatgaccctcgtgggatatttgagagggttttggagccagcagaggccaaactagagagtggggcggggtgggggcggggacggtagtcaaaaacgtcagcgcaagcccaggaagtacctcgaaacctcatcttcctgcccgaagatgaactgcctgaactgtgcggggcagaaaggatgggagcagctgccccaccttcctgcccagtcccagcctctggggagagggtctccccagggcacccttctgggagagacaaggagaaaagttggtgggaggggacggtctgaccaggatgggtgcccagggccttggagggtcctcccgtgctgcagggacccgcaagaaccccgggagctgcctccctccacagctcaccagctcccccgtgagctcaagccaggaatttcaggcaggctctcgggggtccccagacttccttctactccaaggagcctggggagcccgggacctcccagaaaagcatgtgggcagctctgccctaggagaccatggttcttgtcaagaaaaagtcaccgaagtccaagaggctcctccaaagaatgtctactgaattcccttccccttccttcggacacaaaatgtctggagaggcaacaacctggttccaggttggaaatggagccatattacgctgctggggcacccaccactcagatctccctctcacttctctggcttccccctgcatgtccccttctgggcccaaatcctctcctgagagcccccccacccctggtttcgagcctgcaatcatttgaatgacattcaggtccagctggctgcccgtcgatcacgactcgaacgcggggtaacatcgtgtgcatgtgtgtgcgggggactggggggacagtgaaagagtcccaggcaaggatccaggagtcagacccggccgggatctgctacccttccctgcgcaccttaggcagaccacacgacctatccctggtttggtggcctcataataatcaccaaggtttattaagccgctgtgcgcaaggcactgtgctgcgcacattgcatgtattatctcattggattttatatagtgctagcgtctgaatgtttgtgccgcccccgacccccgccccaaattcacatgttgaaaccgagtccccagtgtgatgatatcaagaggcagggccggctggggcacagtggctcacacctgtaatcccagcactttgggaggccaaggcgggcggatcacttgaggtcaggagttcgagaccaccctggccaacatggcaaaacctcctctctaccaaaaatacaaaaattagccaggcgtggtggcgcatgcctgtaatcccagctactcaggaggctgaggcaggagaatcgcttgaacccaggaggcagaggttgcagtgagcccatatcatgccactgcactccagcttgggtgacagagcgagactccatctcaaaaaaaaaaagaggcagggcctttcgcgggtgattaggtcatgaaggctctgggtcggcacctgaatgaatgggaatcagtgctcagagaccctagggaacttgcttgccctttccagctgagcatgtgcccagcatgtgaggacataaaaggcaccatggatgagaaacaggctctcaccaaacacctcatctgtcagtgtctttaatcttgggcttcccagcctccagaactgtgagcaataaatatctgttgtttttgagttacccaggtattttgttatagcagatgaaacagactaaggcatagggaccaatattatcccatctaataattgagaaaacttgggcttgaaaagatccatgatggcttacgcaagctcacagggctaataagcgacggagctgggatagaatttaggcagttgaacttcatgacatgaacataaccacaattctcatgctaaccaatagtaaaataataataataaacaaataatgaggctaggcgcagtggctcgtgtctgtaatcccagcactttgggaggctgaggtgggtggatcacttgaagtcaggagtttgagaccagcctggccaacatggtgaaacgccatctcttcgaatgctacaaaaattggccgggcgtggtggcgcacacctgtaatcccagctactcgggaggctgaggcaggagaattgcttgaacccagaagcagaggttgcagtgagcgaagagtgcactgctgccctccagtctgggtgacagagcatgactccatctcaaaaataataataatgatgatgatagttgacagaggttcttttagtgctaaggttctggggaaacctgcaaatttagtaaaggtggacccacattttcatgttttcaggtcatgatgagtgacctcgctcctttaggaaaaaagagagaaatattccctttgggaggcacagggacagcctcctgggagatcagagtctcgcctctgcctctgcaatcagccaggatctgtagacacagatatttatgaggcagtctgcggtgctctatttcttcccccattcttatgggggtgagaggggcagaaggagaccaaaagccacatacttgcaaagtcatccttcctctggagaccaagaagcagcagattcttttcctgggaaacaagtctatcaggcagacatctgttactctttgcgatctgtatgccataacagtttaaaaaacagagtttaaatgcttaaagaagaagaaaacagtttgcctgtgttgcaaagcagcatataaacggtgctggaattagcacaagggaaacatttatctttcctagataatctcaaaacaggcctttttttttggattgtatataattatgtttattggcatggaaagatgctcatgatatatcactaaaggaaaaacaaaaaacaaaaaacaaaactggttgcaaacacaaactaggctttttaaagaagcattgactctgcctccctggctggggccggggccctctgtgtatcccatagaggaaagggtagaatgggccaagactggctgggtagtagccttcttcctgggagaacagagacagagtcacattttccagcaggaatgaccaaagatttgcctgagctggataagcccagcctggtgtagtgatggatggtgggctctggggatccaaaagacctgggttccagtcctagccccactatgagtcgtggtgacctagtgcagtttcaatgctgctggagctcacttctccactgacacagtggaagtcacatctcctgcacacaggggaggtgctcatgaaagggtgggcttctctccctccaatctgtgttttttttattgttttttttttttttgagatggagtctcactgtgtctcccaggctggagtgcagtagcacaatcttggctcactgcaacctctgcctgctaggttcaagcaattctcctgcctcagcctcccaagtagctgggattacagacatccaccaccacgcccggctaatttttgtatttttagtagagacggggtttcaccatgttgactaggctggtctagaactcctgacgtcaagtgatctgcccgtctcagtctcctaaaatgctgggattacaggaatgagccactgcgcccggcctccaatctgtgtttttatgacaaaggcatggattggccatgagcaatgggcagccctggggtggcaggctgtgaatgagggggaaggggctgcctcgaggggttcggtcccctcctcaggagctaacacacagcctgagacctgaaggatgagaaggagccggccacaccagggtctggaggaagccactctgcgcattggccgtggcccacgcaaaggctgcgggaagcaacatcctgccttgcttccggtcggcttcaggcctgtgaggctgggaagggccagtcgtggaggatggagggtgaggtgggactgagctacatgtcccgggccttggttatgatctgaattttgatgttgagaacaagaaaaagacacaaaaggggcttaagaagagtgagcagcatgaccaggtttgttcttttaaaaaactggatactaggccagacgcgatggctcacacctgtaatcccggcactctaggaggccaaggctggaggatcgcttagggtgaggagttcaagaccagcctgggcaacatagggagacccccatctatacaaaaaaaaaaaaaaatatatatatatatatatatattatatacacacacacatacacacacacacacacacacacacacacacatatatataacaaattagccaggtgtggtggtgtgtgcctatagcaccagctactcaggaggctgaggtgggaggatcactggagcccaggggtttgaggctgcagtgagctatgatcacaccactgccctccagcctgggcaacagagtgagaccatgtctcttaaaaaaaaaaaaagaaggatactagatgaagatgaggagcaggggtgtggcgtgaggaggacagaccagctaggaggaggagcctctgggcaagagatgaggtgacctggtcagggcccgtggccatggagatggcaggcatggacacggtgaagctatattttggagaagaatctagaggactttctgatgatcagatgtcgaagtgcaggacagaggagactctcaggccacttccagctgcccctacccagtggccttgtgggaatcaggaaaagggctcctctaaacaagcatgcagcacagggcacccgtgcaagaccctcaccctgagaccctcccttgcaagtgcgaagttgctcaagcccctgattctcactcagagacctggtcaattttggacttgcaaagcttgtagtgtctgtggcaatccaaggggagccctgggctctgcccaaggtttagggaccatttcaacacagtgattctacccctggctccagctgtgtgtgaagtttcttccctccctgcctgggcaccagactttttacagtactcactgcattggacgcaactaaccttgtgaagaaaagagtttttaaaaccctggaagctaatgttacaagactatttagcacttaaataaatgcaagttctagaacatctgcagccaaaatgaaagtaaataatgacagaatgtgagtcatgagtagtttgcaaagattgtaaacaaagcatcctcccaaattcagagccatggcctgagagttgggtaccaattaatcagcccttaactctatcacacacaaaaggacacgtgtcctcattagcaagtcatgaggggaacttagctaactgactgtcactttgctatctggagttcacttaaaactgaaataaaaagcttattccctgaagaacagagcactcatgctcacattgtttgaaagaatcacttcactgccagtgtcaacatgaaacttaacatcctgatatttatgggaaaggcaaaacaaccccgctcgtaaactgaagagatgagcccaaccacccaggcatgtcccatcagtccctctcccaggggctggtcactttctttctgatggcagttgttggtgcagacttcatgtcctctcctagccaattgctctccaagggcagggttaatgcctcattctttcatccccctacattcctgtgtctagtatttggcctggatgtaataggtgcacattaaatatctgttgtgtgagtggatgagcatctttcccaaaaggccaatgttcactccagccctggacttcccgaaggccctgtccaggcagaggatggaccaaaaagggagctgggtaggagacagaaggtttggctcctgtcccagactctgccactcacaagcatgtgctcatgtgagccacgtcatccattttggtgttcccatctctaaaacaggaggaatagctgtccccccactttttaagggtttgcgatgacgcgatgggaaagaagcacttggaaaggggttccacaagtgtgatgtggttcccctcacacctcagaggggagttctgcaattgagaaggcggggcagtggaggaccacggttagacatggtgtgcaacttactctcagaaagccagcaggtaagcagagtggatttggaggtataatgaatgactgcaaagtcacagaagacaaggccacccaggctgtgctctctgcacatgggaactagaaatcagagtacaaaatatggagccagcagataacacaaatatgggagtggcctgctgtaaggcaatagggaatggtggggcctgcagccaactagagattacaatcatgctctgcttcaggcatttgcaaaaagatttaaaacttacaccccatgaaacagcaaaacgcatctatggcctgctggctgggagtctgagacccctgcagatggctgtatcaagcatgtctttttttttttcaaatggagtctcgctctgtggcccagactgggtgcagtgccacaatctcagctcactgcaacctctgcctcccaggttccagtgattctcctgcctgaggctccccagtagctgggattacaggtgtgcgccaccacaccggctaatttttgtatttttagtagagacggagtttcaccacgttggccaggctggtctcaaactcctgactttaggtgatccgcccgccccaacctcccaaagtgctgggattacaggcgtgagccaccatgctgggtctctagcacgtctttttattccaatgctcacttggggccttgctgacactggagagactgcccctcccgggcagggccccctaattcctagagatagtaaacaactagggtgtacctttaatatgcaaagcaaccaatccagagcatgtaacccagatgcctccttgatcagactctcacactgggggccatgacccatctgccctaagcacctcacgggctggccagacaactagggacagtccctataccccagagcctgctgaaatgactcaaaccagcccgtccgaagcctgtttaccctgcttgccttttccaaagaaaccacagtagaggctcttgcccacattttccctctgggctgcctcctgaccctggtgcttcccccacgtggccctgcatgactatcgcatgccacctcagcttaggaactgcgagcaacaaactctctccagtggcagttgtctcctgactgttggcctcattaggcctgaatagtaagaaaacctgtattttcatacatctgtaaaccccaccggagcacagatcatcattgctgctttatttccccctgtgaatctcggcacctagcacagtctctggcacgttgaaaacacaatttctttctctttctttcttttttctttctttctttctctctctctctccctctctccccaccccgccccccccgccccctctctctttctttcttttttaagccagagttttgctctgttgcccaggctggagagcagctcactgcaaccttcgcctcccggattcaagcgattctcctgcctctacctcctgagtagctgaattactggcatgcgccatcatgcccagctaatatttgtatttttagtagagacagagtttcaccatgttggccaggctggtctcaagcttctgacctcaggtgatccacctgcctcggcctcccaaagcgctgggattacaggtgtgagccgccacacccagccaaagatacaatttcaacgctaatcgatgaatggatgggcatagggacgaaagcaaagggctgggtagaagcatctgtttggctacgcgggtccctacacttcagcctcacatttgcaattgcttcaggacactaaattctgcatatgcctcatttctgcgactggcatagacgtaggcaatcaggcaggagcaagccagagggagtggcataagttcacgctagtaggagtaaatggtgattaaactctgaggctcaccaccctgctggcattcagctcttcaggcagctcctaagtgggggcgggcggaaggcttttcttttaatgtccgatcttctggctaactctggctatttgctttattcaaactcttaaaaagagatggtcatctcaaagagtctctgcacccattgataaaaggggaaaagtcagagagcagcctcctcgcccaccttcagtctctgggacctgcccacaacaggctcttccaaagggagtcaatcaggtcgccatgaagcctccctacgtctgcaatggtgcagtgggctgtccccacatccctgaataaccgaactgcatccggttaataaaccgaaagctgagctagagaacctgtgttgtttttcatctttactctttaaaatgcatcaatctagccaggcgcggtggctcacacctgtaatcccagcactttggaaggctgaggggggcagatcacttgaaggcaggagttcgagaccagcctggccaacatggtgaaaacccgactctactaaaaatgcaaaaattagctgggcatgatagtgggtgcctgtaattccagctacttgggaggctgaggcacaagaatcgcttgaacctgggaggcggaggttgcagtgacctgagatcatgccactgcactccagcctgggagacagagtgagactccatctcaaaaaataaaaaataggcctggcgcggtggctcatgcctgtaatcccagcactttgggaggccgaggcaggaggatcacgaggtcaggaatttgagactagcctgaccaacatggtcaaaccccgtctctactaaaaatacaaaaattagccaggcatggtggtgcatgcctgtaatcccagctaatcaggaggctgaggcagaagaatcgctttaacccatgaggcataggttgcagtgagccaagatcatgccactgcactccagcctgggcaacagagcgacactctgtctcaaaaataaataataaatgcaccaatctgctctgcttgacaatgaactgaatttctctgatcacggggcccttgtgtgtcattctcagcataaccgtctccttcctaagttctggaaataggcagagagaagacaggcgcagagtaggcctgtctgggaagtacctgaggagggtggagaagcctgtgtttgctgtttctgatgaatgttgttgggttatttagtgcttggcagtgaacggttccctgaagaccatccctttcccaggccctggatggaagggcaggaaacatttgaccacagtgtctagacagcgaggctagggaatctggggggctgcccaggagctcatatgggggacagccatcagtagggtaactgacccagactagaaccagattagggcttgtaataggcattatcctagtctaattattgagatcaccccctcttttctcccaaaagtgtcctagtttgattgataaattatacagccaccttcaacattagtgaattttgcaaacaggaaagtctgagttgggaggctcacacgcaacagaagctggtcactttgtacaaatagaaagggcttagcaaacatcctggaaaaggcctggtggcagcacccaaccccctacaaatagcaggaacaattcaccaaagggaactgagcctgaccttggccctggtgggctctgctctaaaagtggagttcctgggctggcggggacagcctggcccaagcgtgccccgcctggcccaagcgtgccccattcacagcctcctcacccaagaagggcaggcttcaaggcagcatttcttttccccgttgaagtctcaagccagagttagcaagttcagcaaagggcaggagcagagaggaaaggattatgatgtgtccccgatgggtacaggagaagggaacagccccaccaactccaacctcagtacgcacctgtgctacaatcccattcaacaacaccttgagttgccatggggaccctgaacaatttcccacttgtgttttttttccttcctggttgagatcttgtttctgtcaagatgaactatttatctgtgttgcatgaaatgtcatgggttgtggtcaaaaccaggaccaacccacgcacaagaaataataaccctttgatgacactcacacacaagcttcccaagtctttagaggctgtcagtgattcattttctttttccagcactgaacttgctctcgagaaatatttaacccaaaaggcgactggcaggccatacccccagtagcctgggtttgccggatcaactcatgtttgagttaatttaccaagtgacctgtggacatgcgtccactcaccagagaggcagagcaaacacttacaaggtaaaaggtagtgtgatacgtttcaccttgtggccttacatgaggtttaattaagctacaaaatgctcgacgtgtccagtgttgaaggaatctctgttttgtaaactaaaacttccaagttattattattctttttttatgttagcttagccatcatgcaaaatttactggtgaagcagttaataaaacacacatcccattgaagggttttgtacatttcagtccttacaaataacaaagcaatgataaacccggcacggtcctgagaggaaattcctttgcttcttaaagctgccagtcccggctttttgggggctcatgtgttataaattctggaagctcttttagctgcagtttgagcatcaggcaaatcttcttcctcttcctcggttcgcttgtgttttaaaaacaagtcagactttaagaagcggctgtagctgtcgtacttcatgagattaaagatctaaggaggaaaagaaaaaagagtctgaaggctgaggctaatccaggccataaatcatcccatcagatatgtattaatacctaccatgtgccaaagaatactaacatgtgcaaagaacacactaagaaagctcaaataagtcatctgctagacaaggcagatttcctggagatttttggtcattatgcaataatctcaatggaatatatagacagtcacatgaacaaatatgcctttattttccacggaaatatagattcacacagcactgattcagacccttgtaccaagaagtccttcaagactctccactttatttgcctagataagacaaggatgtatttctccaagagcttgagacagccgaatagaaaccatttctgtagagacagtggtgttaaaaagatcactgacatatcatatgatgccagcattgttaagactcccagtaagtctggcatccgagatctcaaacaaacctattattgtaccaggagtcaaaatgaggcgtgctcactgcagggcagggcagcaaaactataatcttagcaagggaacaggtcccaaataaagaatagagcagccagctgcagaatgccaacatctgtgccatcagacaggctggggagcacatccctagaatgaaacaactctaaggtatgtcaggtgagcgaagaggacacccgacagagctgaagtgccccagattagacggctgcccccgccggcatggcaggtgctcagagggctgtccccaggcacagtagcttcctctggccgccactgaacctcttttctgggccacagtccttgtgaccagcattcattctcccccactgctacccaatcctgtgccatctgccctcctcccttgccccaggaaaggggcagagaaagagaagcacaaagccttttccagctgtcaagggctatgatctctttcccacccctcatttctctctctctcagacctttccacttaactcgcagtacactctgcaactaaaaatccacatggttcaccctggtacacggaacaaccaagtggaaagttccagagatgtctagaatgtcactgactgccaggcggggttgtcaagtggatggtaaaaccctgacatcttttaaggctgccctctcccaacacacatacactattttgtaaattaaacatctgagggtgctgggggcggtggctcacacctgtaatcccagcactttgggaggtggaggcaggtggatcacttgaggtcaggagttcaagaccagcctggccaatatggtgaaaccccgtctctactaaaaatacaaaaattagccgagcgtggtggcacacacctgtagtcccagctattcaggaggctgaggccaaagaatcacttgaacccaggaggcaaaggctgcagtgagctgagatcacaccactgcactccagcctgggcaacagagtgagactctgtctcaaaaaaaaagaaataaaataaaaattaaaaataaaacaaacatctgagggactcaaaggactcagaacatctgcttggaggatgggaggtgcttcaggagggaactggaaccctcaaattttacaccttcatcttcccaagatggcttcaaccacagcagaactgcctgagtcactgtgctataaacagagtccacaacccagagaaagacctgggactttaggttttctttaaactgttaaactagcgcctgcccatcccctggtgcccttctagtcttgcccgagtcctccagctgctcagcaagaccctgcctccttaagcccctgtcctgtgccacactagagcagtcatctatcttgtagccatcctgtaattccaggtgtgattgtaatttgctgaggtttacagaaaaaaaaaacaaacttttttttaatcccagaaaatacaaaaatcatagccagggctgaggtgggggatgagaaacgccattactccttcatggcctcccaccgacgtgctaagcaagcgtcaccatctgccttattcagcccttccaggcacaagagtccccaaggggaaactttcagaggctcacctagttcaaagtctgcaatgaacgctcaaatgtgactaatgaaaccagttgcacgaaggtcccacctggcacccagcctcagtcctgtacccactcccaccccaggtccacgcagatgggacccaccactctaagcaggatgcggtgcgacccaagcgtctcgtgtgaagtctgcatgtgggagaggaacatcctgtttgcctgtagtggctctgaggctcagacttcaaagtagagaagaaaaaaggccggtgctgggggcacccagggcagaggaggagggggagggaaggaggctgcttcggctgggaggaagctcaggggctgcaccgggctggcaggactcgaccccgagatcccgagatcccaaggctgccagcaagcctgaggggagggggctgcgaactatttattaagagcataagggccactccctactggggcaggtgtgaaatgccccacgagtgcagaagtccctcaggcagaggtttcctcctctgagagcccttgcccatctcccgtgctgctgcagtgactgggaggcagctgtggctgttggacccagacaggctggagaaaggagaggatgtcgcccccaaagccctcgtgcgcctgggctgtgggaagcctgattgctttacatggggtgcacgggcagacttctgactgccaccggccaacgaccccctgggcctggctcaggagcacacagcaacagggtgctcctgggacggggctcagcaaaggtgacttagaggatggagaatgcaactaaggccgggtgcggtggctcatgcctgaaactccagcactttgggaggctgaggcgggcggatagcaaaatcctgtctctactaaaaatataaaaattagcagggcttggtggcacccacctgtagtcccagctactaaggaggctgaggtgggaggatcacctaagcccgcggaggttgaggctgcagtgagctaagatcacgccactgcactccatcctgggtgatagagccagaccctgtctcaaaaaaaaaaaaaaaagagaatgcacctaaaactttcttccaagaaagtggccagagatcgtgtgcccagctactggccagagcctcatctatcacagggaaaagagctgtgactggggcccagtaagtgtttaccagtggctgaagagaaatcgtgcgctgtgcagcagcagaggctggggaaatgaacccggctagtaccaacgcggctgcagtgccctccagccctgcgctgggcagcgtgtgggcattctttcattcagttctccctccagcgctctgaagacccccatttgacagaggaagaaacgaggggcttaggggttcctcacagttctggaggctagaagtccaagtcaaggtgccatcagggttggtttctcctgaggccgctgtcctcggctcgtagaccacaccttctccctgcgtcttcacagggtctccccggtgcacgtgtgtccttacctcctcttctcacaaggacactagtcagattgggttagagctcacctcaatgtccttgtttaatgttaattacccctttaaagccctatctccaaataaagtcacattctggggattaggacttcaacatatggattagggaggggagcacagttcagcccataacagtgagcaaaagagaagggcggaaggccagccctggcaggctctgcagcccccactcccaaccatgaggccatctgccactcgcatggcaggacaataaaaacgagggctgcaaagagagtaacatggaaaactgcccgtgaatgttaaatgactgatactaaattttaaaaacacaccctatctaaaaacaatgatcccaaatacgttcttttttgttgttgttgtttgcttttttgagatggagtcccactctgtcacccaggctggagtgcagtggcacgatcttggctcactgcaaactccgcctcctgggttcaagcgattctcctgcttctgcctcctgagtagctgtgattacaggtgtgcgccaccacacccagctaagtagagacggggtttcaccacattgaccaggctggtctcaaactcctgacctcaggtgatccaccctcctaggcctcccaaagtgccgggattacaggcatgagccaccacgcccggctccaaatacattctttaagagtgtatccatgtgtctaagtgagaaacaatatgtccccaaaggtcagtagtggggtgaatggtgttcccccaaacttacattcacctcgaatctcagaatggacctcatttgaaaagagggttgcataagggtctcaaaataaaatcatactgcatttagggtaggccctaaatccagggactgggtgtccttatcagaagaggaggggacacactgagggaagaaggcgtgtgaaggcagagggagacatcggtgatgcagccacgtgccaaggagcgctaaggagtgccggcagccaccagcagtctgtaagctgaaggggcaagtaagcaccccccacaccctctcgccaccacccaccagagtcttgtggagaacagggccctgccaacaccttgatgtcatattttcaatccgtttctgctgagcgaatacgtttctgctgtttgaagccacttgacttggggtcattgcttatgacagtccaaggaggctcatccagttggcttgttgatttcacctcaccccggctcaaacacagaaaatgagatgggcctaggggtcccagacagttccaacaagcagggatccctgagggggagacatgacctcaccaggtttggactgtgatgggcacctgaacaacacggtcagactccttaagggtccacaaggcagagaaagaagaaaatggagctatctgggctaagcaggaggccgcaggtgagtggaagacacgggaacagagctgaggccaccatccgtccaacaaacggctgctggtgaagcggaaaactcaagttggcggctgagctgcattctgcatctttttttttttttttttttttttttggccaagacagctgcggcttagcaagctttggggttttggcagccccacatctgcaagctgcacgcctggactgtaaactgtttagcatcgttgccttgggatccaatcctacaggctgctggaagtgagactcggacaaaaatgaggagggaggcttcctgcagatgtgcaactctgcacaaccgtcctgcagaacaaggtctttatatcaccaagccacctcctctccagatcccagacattgccatggctgagcaggatttgccttcctgaaagaaaaatatccatgcagtgccccaacttcagactgttccaaatgtgccgctccaggaaaggacgtccccctgacgcatactcatctgtgcagaaacgaggacctcaaccagccttgaaggcccctctgtgaatattgcgtcactgtctccattcattgcgtttcaagcctaataaatattttaacacttctcagaagacaagtacagaagacctaaacaaaacatgcatcctctcttctcttcaaaaccctctgccattttattttaatccagcacaggaggaaaaaaatcattccttaaggcaatgaaagtttaattagcgggatatcatatctgctttaagaacttggtttcgcttgtatatgaaaatcgctgaaagaaggtggaagcaccgccgtctctgaattgcggctctagaatgcgtcctctcttcacacacatggactacagacgtgcttttgtacccacgcgaggagacagaaagggggaagaaaggaagctcctgtccctccagccctcagaagtggctgggcattgacgaggctgtcggggcaaggcgcaaacagggatgtgcctaccccctaaagtgaagaccacctccctctcaagtgggaacgggctgcacccaggaggaggtctgagggcagctggcagacagcagatgagcagacgaagcagctcaagtcagcccttgccccagagcgccaggacgggccacacagaaggctctgtcgccttgcacggctctccagcttcacgacagaccagccagagatggacagtgtgccaggggtgggattggaactccagaaggagtctggacaccagcgggatcagagagacctcgcttggacgatatcccctcccaagctcacgggttcacgcgtgtggcggtcacacgtgtggagcggattgtccgcttttttctaccgtccacacgattcaaattccaggcccaaatgacatgactcactttctgctgggggtgaaggcattttaattttgccttttgccatcggaaggggagttgaatgctcctctgagtgccactctcccctcctcttcccccaaatacttttatttatttattttttttgagacggagtctcactctgtcgccaggctggagtgcagcggcgcgatctcagctcaccgcaacctccaactccctgattcaagcaactctcctgcctcagcctcccaagtagctggaattacaggcacgtgccaccacacccagctaatttttgtatttttagtagagacggggtttcaccatgttagccaggctggtctcaatctcttgactttgtcatcctcccgcctcagccacccaaagtgctgggattacaggcgtgagccaccatgcccagcaccaaataccattttaaagttgcaagaaacatctcaaagtatctcgaatactgcccttcccatcctgaccctcgtgaggcagatggctacggtgtacacagacagccaacctcccttctgtttgaacaaaaaaccacacctgccctttctagcggagcatgctggaaaatacccatttcttccctgcatttgatcttttggagcaaatgtcacctggcacccataagactgacacatcctaagtccctggctctggccaccaccacagcctctgccaccacccaggagaggggaccatggtcatgcaggggcactcaggccaaggtcctgtttggagaaataatggggcaagggagagaatgggcccccaaatgactgccacaggccggacagcccctctctcaccctccgaggccctcaatagctggcccacccctcttacttacgttgaaaaaggaagcatttttcccctcttacgttctgggaaaactcaaagaaactgcattgctaaaaagggaccccattcatggctcctttctctgtcaaggatgtggctgggagcactagcatctcacccaaggctttttttttttttttttttttttgagacagagtctcactctgttgcccaggctggagtgctgtggcatgatctcagctcagtgcaacctctcccttccaggttcaattgattctcccgacccagactcccaagtagctgggattataggcacatgcaaccatgtccggctactttttgtatttttagtagagacggggtttcaccacgttggccaggctggtctcaaactcctgacctcaggtgatccgcccacctcagcctcccaaactgctggttttccattttttttgtaagcaccagaggctgaggacttctttttgagtggagaaggccacctcatctctgcttttccaggctagagtttagcaccagatccaaagcctcgggaaggcaccctagcagacgcaaactctgcttgtgtatttatttattttgagacagagtttcgctcttgtcacctaggctggagtgcaatggcacgatctcggctcactgcaacctccacctcccgggttcaagcgattttcctgcctcagcctcctgagtagctgagaatacaggcgtgcaccaccatgtccggctaatttttttgtattattcgtagagacgaagtttcaccatgttggccaggctagtctcgaactcctgaactcagctaatccacccgcctcggcctcccaaagtgctgggattataggcatgagccactgtgcccggcccaaaatctgcttttaagtgtaggcatggggacccctgatattcatggaagaagaatgagcaccccacaaccccaaacccatgcccttctcttccatggactgagaaagccacgaagctgccatgtgcaatgatctggacctttctatcttcatcaagctcatggctgttccagaccatgctgcgctgtatatagaacttaaaccaaaggcttctgagcaagaaaggtgtgtaaactggggctaagaaatgtgccagaggagaattttgttttaaatctttcatatggaacaactttaagtcactgagcagacttcaatgtgttccattcttcaatgtttgagtacagcctgaaaggaccaataacgtcatcgatttcctgctaagaagagagaaggagcggcaggactgggggatcttaacttttcacttcatacccacctggacacatgaattttcttttctttatcttaacaataagcatgtactaattcaataacttaagataattttaggccagacactgtggctcacacctgtaatcacagcagcactttaggaagccaaggctggaggattgcttgagcccaggagttcaagaccggcctgggcaacatagtaagaccccatccctagaaaaatatattttaaaaattagccaagtgtggtggcacatgcctatagtcccagctactcagcagtctaaggttagaggatggatcgagcctgggaggtcaaggctacagtgagccatgatggtgccactgtattccagcctcgatgacagagggagacccagtataaaaaaaattaaaataggcagggcgcagtggttcatgcctgtaatcccagcactttgggaggctgaggtgggcagatcacttgaggtcaggagttcataaataccttattattataacctccacttcacaaatgagaaaagctaggcacggagagggagcaagtcttgtccacaatctcacagtaactaaattctaaagtgaaagaaggccgggcacagtggcttatgcctccaatcccaacactttgggaggtcaagatgggaggattgcttgaggccaggagtttgagaccagcctgggcaacatagtgagaccccatctttacaaaaaattaaaaaaaaaaatctgagcatgttgacgctcgcctgtagtatcagctacttgggaggctgaggtgggaggattgcttgagcccaggaggtcaaggctacagtgagccaagatcacaccactgtactccagcctgggtgacagagtgagaccctgcctcaaaaatatatatataaataaagtcaaagaagttggggtaggggcagcagggggagtcagatctaaggaaataaggctgtagttatcagtgactttttaacaccagggcattgaacgctcatagactgcttggcagcgcagctcagagaggtagcagagtatttgcccaaagccccatgttacagatggggactcagaagccacagtaagaaacagaaccctcctggggtcagacagcggcagggctggactagaatcccccacttctgcctctggtgctcagggccaagctcatgcatgcactgtgataacagtgatgaatctggcatctccatatccagggagtgatgggcagggggagagggggaaggggggagaggggaggggcagagctcaggccactcccactcaccatacaaatggtgagccacagtcaggaggtcagggtttcacggctgactttctaataacggagctggctctgcaccaagccatccgccttctcttgcccaactggtatgggacgggcacagccctgaactagggacctgagccaaggggctcaggctgtaagaggtccaagccttaccagcccaaccagcacattctataaacagccactgttcacatccctgcaattaaactgtctaccacagcctcggggcctgacccagccagtccctcccaactgaactttcaccaccccctcatgtgctacattcctacaatgctgaccccctaacgcacctgctgcccctgcctcggggcctttgcgctcacctctccttggaaggtcccggctcccaggtcctctcatccagatcccgcttgccattcagatcccagtcacctctccagggagccctccttgagcacagaccctagcaggcctcttccagtacctctcagctcatcccctgttgcatttccttcttagcattgatctttctctgccctccgtgtgggggcagatgctgatttccctgttgtacacacagttcctagcacagtccctggtacagagtagggcctcagttcataattgcagcataaaggaatgaataaaacaacaaatccacaaaccagcagaccaacaaggactgaatcaaaactcctaggaatagatatttttgtttatttgttttttgagatggagtctcgctctgttacccaggctagagttgaatggtgcaatctcggctcactgcaacctctgcctcctgggttcacgccattctcctgcctcagcctcccgagtagctgggactacaggcgcccaccaccacacttggctaattttttgtatttttagtagagacggagtttcaccgtgttagctaggatggtctcgatctcctgaccttgtgatctgcccgcctcggcctcccaaagtgctgggattacaggtgtgagccaccacgcccggccgtaatacatgtttttaaagaagaaaagacactgtaaggaactgcaattccctgaagaaaccacctctttgtaaggtaacccccttccttcctgcttcctccaacttaaatttgtccaacggcagcctttgactctaggctaacgtactagggaaatgcccacagcaccacctttcgcctctcctggctttgcctccaaagggctgggcacaccaagcttgcagaactgaattaaatcagagaaccatctcgccacttacatgaatttcccaggtagcaaagctttaagcccctcaagcttctcttaggatgcctttggctggacacagtagtagctcacacctgtaatcccagtactttgggaggccgaggtgggtggatcacttgaggccaggagtttgagaccaacctggacaacatggagaaatgccatctctactaaaaatacaaaaattagcctagcctggtgacatacgcctgtaatcccagctactcaggaggctgaggtaggagaatcgcttgaatccaggaggcagaggctgcagtgagcagagatggcaccattgtactccagcctgggtgacagaacaggactgtctccaaaaaaaatgtttttgatgaagtgctcattaaaatgaataatgcactcttcacataatacgccgacctcaatttcacttctacttgatggtttggggtcaccaggctcacttatcatgtcactgtcccacagcacagggatgcccatggtgcggcgtgtggcaatggaggtccccacgcccaggctcaggcctcggtgctgtgcttgtactcagtgtcatttctgtgtcctccctagctgtcagtgatcacctcttgctgctcatcactccatagtctctaccacaacttcaaatctgctatgaatggaaaaacctgttagaactgtgtgcaaaccaagaataaacaggacctgactgaaaactcttgaagctctcctttaaacagggtgcatgggagttggctcatctagcctggggctcagggaagattttcccgttcttctaggttccagcggtgccctacaaagtcagagctgccctactagaagctcagagagcagcggagccgcacgtggtgatgaggggctaagttcgggggcggcggtgctgaacacaggaaagcggctgctctgcggctccaccatgaagcccagcagtgctcagcaaagccaaagccgcgggagaggcttttgaaagttccgtgaaatcttgtggctccaaacatgttcccctcagcttcaatctccttcacttaggaaaacagagctctcgagggagcctttgcaagaaaaaaaccggggctaatgctgagcacgcattttgacagttacagcaaggccccggagagacagagttttcaaagcaaaacggaacacaggggcccttcacatggagactcactgtgaaatcggctctgattccaaataccttgttttcacccaattatgccttaggaagaaagttcgtggatctttctctctatgcaattaaaaaaaatttttttttttgaggtggagtctcactctgtcgctcaggctggagtgcagtggcactatctcggctcagtgcagcctcagcctcccaggcttaagcagttctcctgcctcagcctcccgagtaactgggattataggcgcccaccaccacgcctggctaatttttgtatttttagcagagatggggtttcgctatcttggccaggctgctctggaactcctgacctcaggtgatccacacgccttggcctcccaaagtgctgggtttacaggcgtgagcgactgagcccagccttccaataatagatttttaacaacagagtataacagtacttgctttacattcagcagtttggactgcacatctgtttggtgtgcataaacatatacattattattacacttattaggccacatctgttaggggcatgtgcatatgtgtatttatagaaaaaaagatggaaagtctacagataaaatactatttggtggttatctccaagtgtgcaattatgcaataaagaaatgatttcttctttatatttttgtttcccaagtttcttttgctgagcatgtgtgatgcttacagttggataaaaactattttaaaaaatttttctgaggctgggcctggtggctcttgcctgtaatcccaacactttgggagtccaaggctggagaattgcctgagctcaggagttcaagaatagcctgggcaacatagcgaaagttcatctctacaaaaaaaatacaaaaattagctgggcatggtggcacacacctgtagtctcagctacttgggaggttgaggtgggaggatcacttgagcccgggaggccaaggctgcactgagccgggttcatgccactgtgctccaaccagggcaacagagggacatcctgtcgcaaaaataaaataaaataaataaataaataaaattctttgtcattaaaaaagaaaaaaaaaacaatcagcctctgtcccctgtgtttcttcctttctgtgctggctaagcctcccactgaatgagtctaaggggcacgcctactcataaggtccagctccgttctgagctgttgggcaggcgggctggatctctcagagcctgcagtgctaccgcatggagtcagaactctcccattcctcatcctaccttggctcccgcagtcctgggaagtgggatgacctgcattcacaaagcctttccaatccctctgctccaggggcctcaccgagctttgagaaacagcaagaggctgcccaggagcctggcagagcaacacaggccatgatggtcatggggggagcatggtctttgaaggcagatggacaagagggaatctggcttccagcacttttgctccctgcatgacttaatgctaaaaaaaacacttaatctctctgaaccttgcttttctcatcagcaaaatgggaataataacactcattggagataaaatgagacaatacacaccaagtgtgacatcaggctcaaacgggcagtcctaaatggtagttagggccaggcgtggtggctcacgcctgtaatcccagcactctgggaggccgacgcgggcggatcagttgaggccaggagttcgggaccagcctagtcaacatggtaaaaccccgtctctactaaaaatacaaaaaattagccgggcgtggtggtgtaggcctgtaatcccagctggtagggaggctgaggcaggagaatcgctttaactcaggaggcagaggtggcagtgagccgagatcgagccactgcactccagcctgggcaacagagtgagacttcgtttcaaagaaaaaaacctgaaaaggccaggtgcagtggctcacgcctgtaatcacagtactttgggaggccaaggagggtggatcacttgaggtcaggagttcgagactagcctagtcaacatggtgaaaccctgtctctactaaaaatacaaaaattaactgtgtgtggtggtgggcgcctgtaattccagctactcaggaggctgaggcatgagaatcgcttgaacctgggaggcggaggttgcagtgaaccaagatcaagccactgcactccatcctgggagacagagtaagactcggtattaaaaaaaaaaaaaaaaaagaacaaaaacacagaaccaaaagcgaaatggtagttagtgttgtcattactgagaatacctagagcacagaggtcagtacaggttcgcaaccctggctgcactttcaagtgccctagggagctctgacaagattctgaggtccagggtggggtcgatatcctcatatggctacagtcacaaaaactgccttttcaccatacattccactccctttcccagcgcaaatcaatgcccatgcgtccttccgactggctcaaattcaccacttccaggaggccctccgcaagtctccttcaatagccaaatgtgaatcagaattcacatggaatatgctgcccaatgctaaccttttcattatgcctcaggggctacatgatgaactattaatagcttacagcattaggccaccagaagtatgtggaggtgtctggatatttgcacagaaacagcctgccactttgagttctcctgcttgctttctggagttttccgtctattcttaccttcagcaattataggttgctttctcagtacaggctcctcaaatagctccagcctcccctctaatctggactgagaaggcagataaactggtctaaactgtgtgtagaccaagattaaacaggcctggggggactcctgtggggcaaatctcaagcttagaattctggtccccactctccccaaccatggcccctcagtgtacctcggtctgcccggccgtatgagatggtttccagggagtctaacatcgggtgtttcagtaaattcttccaggcctggaattaatgtaggttttcaaatcaaggtgcaggcagggaagtcgggttacctggtcctggagtttctggaacatcagagggtgcggttcttccaggatcttctcgttgagccgagactgcccctccacgttgacctgtgatgaggccttgctggacagaaaggtcatgtagatctcctttgccttttcctgcatctggaggagacagatggggccttgtgctatctgcacacacagccttcccggcctgagccctgctctcccctccagccaggcccacaggagctgctgtggcaagagaaaggcaccccccacagcccaggggctctcaggccactccagagagaatttctatatgggagagcctgcactgccaagcccctacccccgccccttcatgcgcctgcagccacttctcctggaacaaaattgctgcattaaccattcagaagtgatgacagaaagaatcctggcccgcagagagcactcagtaccatttacagccatcctgtggccgggcacagtggctcatgcctgtaatcccagcactttgggaagccgaggcagattgatcacctgaggtcaggagttcgagagcagcctggccaacatggtgaaaccccatctctagtaaaaagacaaaaattagccaggcgtggtggtgcaaacctgtaatctcagctactcaggaggctgaggcaggagaattgcttgaacccaggaaagagaggttgcagtgagctgagattgcaccactgaactccagcctgggtgacagagtgagactgtctctcaaaaaaaaaaaaaaaaatcaagttaaagtatgcacacctactatccctaccagttattaagcgcccactgggctgcaggcacctgcttggagggatcccatttccttaatcccctggacatgcagcaaagggcattttcctgttagccccactttccccatgaggacacagaggtcaggagaggtggcatggcttatctgagagcttccgggagccttaggactgtttggctccaaggcctctgaattctgctcagttccacttccgcaagacacattggcccctccaggttgtgcggtatgcggccttcccaggcagggtgcatttccttttagctaacgagatactgagcacagcagtggagaaaacactcgctgcccgccctcaagtcccgagtgcagtcctgctgggaagcaggagccgtgagtaggtaccggcttcctgtttcacccgaaactaaccgaggctggctcaggagcactcactgatggtaaggagatgacttcacagtgagaactgtgtcttcaggacaggcgcctcagggcggggctgcaggcgcaggagccctctcctccagaacttcccctgagggctcgattttcttttagagaaaggagacttcctgtgctcatacctcgccaacagcaaaagcggggctgtttctctgaacgttagagtctaaagcatgaccttaccctacagagcaaggcagacaacaaatgcctctaaaatgcagccacacagctatgacatgtgtgtggggggcctggaaaactgcctttctctccaagagcccaactggggctccgcatgtgctgtggggcttggtttgggaaatcccaagctctgcaaaccttctgcccttaaggaaaccaccagaaggttttgatagctggggcatgaaaggaaggaagggtagcccttttttagttcagggcactggggacaaaagatcctgagaagccacggcctggccatgtcctgttctgcgagaaagcaagcctcaccagcacttgcagggagacggcccaggttgggtgaacaccgaaagccatgctgtccaccctgtcttcactgtcaataggagcaatgaatcgatgccagactcagtgacacaggagtctctccagacaagcgtggctatctaagggacaggtctgggggccatcctcgagacccaagggggtggcacttaggagctggccctgctgtcctctccaagacccaccagctccatgaagccacagcctccctccaccacccccattccgtcaggaagcaacccttttggaaaaccacttcctgttttaaagccacttcatgaaaggagaatttcggccaggcagatgagcaaactccatgcagaggtctgggggcagaaatcactttagacctcccctcctccccttgacattcacacgcacacacacacgcacacacgtgcacacacgcacacacatacacacatgaatccaggatatcttgagtgattctgaaatagagaagtgcaatgaatggcttgagtctttgaggtggggcagaagaggccgggggagaggaagtaggttccagtgactgcaggtatataagctttgagggtctcagccctgccctcttccaccggctgtccctcctgagtctgcgtgagaacaatgtggggttcaaggccctggctgaccagatgcccactgtgagcagctgcagggctcagcttatctcggcggagctaggaagtatgactgaaaagggaaaccctgagacggcgaccacaagccagtcacgggaaggcctggtgtctaggccgagaacatgagcagaaaagaagaaacagtctgtggagctattttgatagatttttccagagctttgttaaccctattctagctactgtccgggtaggaacagagctggtggagttgattctgtgtctgtggcctggaaggatggccgacttctcttccacggccctgacacatgtggctggccacagcctggaccagagagcccctttctccctggggagacctgaagtgtccagcatctgaggctgtcctggcaggtgctggagagggccccaccttggcccatcaactcggggactgcccaggaagcacctgcaccccagtgagcaccttccaggcaccccacaaggctgaggcccttcttcgaggcccagcagtggctcaactgtgacaatgctcagccagacgtcagctctcgaacccggctccctgcaggtgcacgatcaggagaagcaaattcactttcctatcagccccagaagtgcacctctatgcagacgaacagcaaagtcaccaggggcccaaagctcagaagagcgctgcttcccacactggccccgccctccccaatcgaaccttcccactggaaaataaaagatcccccttgaccccacagctctctacatgggggttaatggcctcaccacccccaatccctctttttttttttcaagatggagtctcactgtcgcccaggctggagtgcagtggcgcgatctcggctcactgcaagctctgcctcccgggttcaagcaattctcctgcttcaacctcccaagtagctgggattacaggagtccgccaccacgcccggctaattttttgtatttttagtagagacggggtttcaccatgttggccaggctgctctcgaactcccagcctcaagtgatccacctgcctcagcctcccaaagtgctaggattacaggcgtgagccaccgtgcctagtctccaattcctttttgaaatctcttaaaagaaaagcatgcacccctgcctccattgtccctcccattcattcctcacgctacacacaggcttccgcccagccagcgctgctccaccagccggctgacgctgcccaggcagcgaggcctctcagaccttcctctggagtgagctggccccagccctgctcagcattgcgactttcttctcttcccgcttccctcaccttgtaagagccctgtcctctcaggatccccaacacctccctgtgtctgtcccccagctcctgtctccctgtgtctgtcccccagctcctgtctccctgtctgtccccagctcctgtctccctgtatctgtcccccagctcctgtctccctgtatctgtcccccagctcctgtctccctgtgtctgtctcccagcttctgtctccctgtctgtcccccagctcctgtctccctgtatctgtcccccagctcctgtctccctgtctcccagctcctgtctccctgtctgtcccccagctcctgtctccctgtctgtcccccagctcctgtctccctgtgtctgtctcccagcttctgtctccctatctgtcccccagctcctgtctccctgtatctgtctcccagctcctgtctccctgtctgtctcccagctcctgtctccctgtctgccccccagctcctgtctccctgtgtctgtcccccagctcctgtctccctgtctgtcccccagctcctgtctccctgtgtctgtctcccagcttctgtctccctgtctgtcccccagctcctgtctccctgtcccctccgtgaattctggggtttcccagacttctgtccttggtgacaactctaactccatgtcccccccagatttcagaccaaccctcccccaagctactgacccatgtagccagttggtttctagcaatgtgggcatggacatcccactgacaccttgaattaacacaaaggaacagagtggtccccttctggctggcaggccctgtagcccctactctgggaagctggaaacttcgatcccctgtagccactccccacccccatcccgtctgctggcctccggctcctctccaccccgtcttcttccagagatggaatgtgggagacaattcctaggacaatgaaaggatcaagacactaactttactaacatcaatttcagaaagagaatgaggcaaagaaaatatccaataaatgatatgagaatattttcaagaactggctcaggaaatgagaagcagtcggagacacagcagatgactctgcagagacccagaagaatgaagccaagcccctgaacaggtggggagggggtgccaacgagaagcgcgtccggagacggcaggagctcgagggcatcaggtagcccagacggaattgatgagggcggcagaaagaagccatcagacccccaggtcctccaccccaggtcctgctccaaacttgagcagtcaggtggctcccccgccaccttcaacagaagagttgagttttcttatctaaagaaacagacccagggaggctccggaacagagaggcacagaggacggcaagaatgagacgccgaaccgaataaagggattcagggaaattccaaatatagaccccccgcgccagcaaaattctcctgacacagttaattagaaatatgtttagttcaggaacatatcaggcttatggccccccaggaagagactagagggcccttgtctggaaaaataaaaaagcagaaaaaactcaataggaggatctgaagatgtagtcaaaatctccaaaagcaaaaaaaaaaaaaaaattaaaaaataggaagaataaaacatgaaattaagggctcaatgcagggcgtgaaaggtcatcattggaaaagagaccagagacaatggaaggaaaaaaagttactaaaatgatgataacaataacaacataagaccatttcccagaactacaaatttccagattatatggctccacaaagaattcacacaatgaatgaactccgcctctgcctccaaagcccctgactgaacagttttagaatactagtgatgaaaagatcctgaccaggtggagtggctcacacctgtaatcccagcactttgggaggctgaggcgagaggatttcttttgggaccagcctaagcaacatggtgagactgcttaaacccaggaggtccaggctgcaaagagccgtgacctcactatattccagcctgggtgacagagtgagaccctgtctcaaaaagaaaagaaaagaaaattgctgggcgtggtggttcacacctgtaatcccaacacttagggaggccagggcaggtggatcacctgaggtcaggagtttgagatcagcctgaccaacatggcgaaaccccatctctactaaaaatacaaaattagctgggtgtgttggagggtgcctgtaatcccagctacttgggaggctgaggtaggagaatcgcttgaacctggaagacagaggttgcagtgagccgagatcatgccattgcactccagcctgggcaacaagagcgaaaccccattaaaaaaaaaaagaaagaaaggaaggaaggaaggaaagaaagaaaggaaggaaggaaagaaaggaaggaaggaaggaaggaaggaaggaaaggaggaaaggggaaaaatagaaaagaaaatagatcctatactatcccagagagggaaaaaaagaaaaaaaaaaaaaaacagaacagtttacatataaattactgattctcaacaaaagtagaagactaaggaataatgtcttcaaacttctgagtgtgtttcaccccagaattctatgctctgtcagattatcagtgaagtaggagagtagggaaaaaaataacatttccactcaacaaggtctttacatacctacctgccagaccccccttctcaggaagctattgccagctgtgttttgggctcttctctcatgagtcattctggagggaagaagtcattctcgtgtgctgttcccaaaatgagggaatgactcaggagagaagaggacttggatccaggaaatggaatgccttcatcctacaaagaggaaggaagttcaccatgtgtcaggcatgggtctagaccctcggagacagtggggaagaagaggccccccactcccagattccagaagacaaaccacacagaagacggacaagtaaatgacatggatatgtgaagttgttgaatgctggataatccacgtcaaggaatgaaccaacacaggtcctattaaaacaacagaggcgagagtgggatttgtatcgactcctcaacagccttagttgatggagagagaaaaatcctcccatggtctccctgctggaacagatgtgataagtttgactgtgaaatccagttaggttacgtgcacaacagaggattaaaaagaactggccgggcgcggtggctcacgtctgtagtcccagcactttgaaaggccgaggcgggtggatcatctgaggtcaggagtttgagaccaacctcgccaacatggtgaaacccatctctactaaaaatacaaaaattagctgggcatggtggcacatgcctgtaatcccagctactcagtaggctgaggcagaagaatcacttgaacccgggaggcggagattgcagtgagcagagatcgtgccactgcactctagcctgggcgagaagagcgaaactccgtctcaaaaaaaaaaaaaaaaacaaagacattcagttaggcgacttctcccagtgcctatgttcctccacactttttgtagtaatttagagcttactccctggttttacttcctaggcagcgggactcactagggaatgcctggagtcagaaatgtggctctgaattctttttttttttgttgagacagggtgtcactttgtcatccaggctggagtgcagtggcgcaatcatacctcactgcagccttgacctccctgggcaactacaggcgcactccatcatgtctagctaattttttttttttttttggtattttttgtagagacaaggtctcaccatgttgctcagactggtcttgaactcctgggctcaagtgatccacccaccttgacctcccaaagtgttataattgcaggcgtgagccactgtgcccagcctcgggcgagctgccgcttaaccactcaagtcatatccctgcatcttcgaatgggaacagtgactcacactggggcccaaacactccaggccaaacaccccaggtgtcaccaatgcctccacccaatctgcattctcaggcagtgacaggagggtggcattcattgctctaaagcaattgccgggtgcattccaggcttaaggacacagactttcaagaagtcctatgctgggccgagtacagtggctcacacctgtaatcccagcactttggaaggccaagacaggcggatcacttgaggtcagaagttctagaccagcctggcaaacatggtgaaaccctgtctctattcaaaatacaaaaattagccaagcatggtagcacacacttgtaatcccagctactcgggaggctgaggcaggaggatcacctgaacccaggaggcggaggctgcagtgagccaagacctcaccactgcactccagcctgggcaacagagtcagaccttgtctcaaaaaaggaaaagaagtcctatgctggatgtcaggggtacaggcatggaaaggggctgcccattcggaagctctctctgtaggatgtggacagggcagggcaacccaacaccagacctgcctgacctgaaaggctggaagaggcacattgaaagtttgaccccctccttccaaccactccattaaagtcctacaggggctttcccagccctgctcaccttggcacccagattcccaggtgtggctgccctgccagcctgaagcacagcacagtggcctccccctcaaacatgccattcagcccttctggtcttccctcagctcttgtcgccagccctgcctgcccacacactgtccctgctcccgggaaccccctcccaatctcaatgccaagtctcagctaaaaagccacttcccctggatccctccccgttgcccacgccttgctcccacgacacatgtgcttcccatctctacactcattgcacttgcacaggcttgctccccttgaggtgcccgttccctggagccgctcacctgtcctgtccctgggctgccttcctgttcagtgctgggcaccaagcaggcacttcacaaagatttggggaattcaactgaacggaggcacagagcagcatggtggtgcagacaacaacgggtgacttcagggagctagttcaagtcctagctctgccacggtgcggggacctcacttccttgtctacactgcaggggcggaccggcccacccacaggcccctcctacctctaacactcaaaagaataaggcaggggaatggacatctgttggcttgcttgactctgagctaggattttatggtgaggctggtcgcagcggtggcacagtctagcatttatcgatggtggtccccaggccctgtcctcggtgctggagacaaaggacaacaatgaggctcttgttctgaaggccctcagcctgaatcctagcatcccaaagcatcccccaccacctgcttctcactttcccctggggcccctctctgcccaggaggctccggccaacgtcatccagaggagagaaaaagccagaaagcaaaatccaagggtcccgcccagtaacagctttcgaggtgggcctgggaagttcaagccaaagagaatccatcttagaatactcccttgccacctccagagaggaaggtggtggagaaaaggccgcgctgcgccatccaggaggatgggtgtctgcgcccggaaaggcctttgaataaacccatgatatacattttccaagcagttgtctgcaaacgcttcacggcttctggcccatagattccagcttttggagacgaggcctcaaaaactggcaacgcgcaagccgcatctgcccatgggtatgttttgtttggtaggcaaggttttaaatttttttttaattagttccaacatttaaaaatcatctggtttcacgtaaggatccaaatgtccagcttctttagaaaaacaggcggtactaggtggaatataagacatgccttgggaagaaagtccaccagggtcgcagggcaagcaaagatctaggagatcaccatcagtaagctggcggagacggaacctgaagcaggggaagcccagacagccacaggccctgaaccaccagctgcagcctgtgcaggcagacagaacgtccttagctggccccagtccccaacactccctccagcctcacaccaggagcctccttcattcacatgacttactggctcctgcaggcatttagccagcagcctcttagaaagatacagggccaggcctcataaacccacccagggcacaggcctccttccccataatctcatctaccctccctcatacccaaccagctgacactgggaatgaaggcaaagaggacacatctacccaggagaacaatcagaggctttctctgcaggatgctcgccaactatgggacgctcagtacgatacactgaataattgacaatccctctgatgcaccttgtgcttttatcattacacatctgcgtatcgttttaccacgtccaaaatgctaacatgtcaaaatgtggggaaaacatcctcataacttattcatgaagaaaaaaattctatgcaatgaggaactctaagtgacataaattgttatttttattttaaatattggtccatttgaacagctccatttaaaaatggattaactcacccttttaaaaatgattaatatttgatcaacacaagatacctaatctgaagcttaaatcttcccccaaaactaatatgaatcaggtttctttaggcaacttcagaatctattggaaaggcagttgtaactttataagggaaaaaaattatcagagtggaggaaatacctgcgtcttatcttgcattttcttaaaatcttcacatgctagccaaaacaaaacattttcttcactgaattccttttttaaaaattcctgtggatacaaagaaaaagagtcacacagtattctactttaaaaaaaaaataaaacaaatggcatttcccttcaaagactgatttggcaaaattcaacagaggagcatggttcagttactcttcgaaaaccccactctgaaaaacaaatgagtatgtttaatgttaaagctataatttcatatgcatttgaccttaatggttttgacattgtaaagaagagtacaaatgaagcaggaatgtactcatatttctaagctgacaataaattaccaaaaagtaaattaaagtggaagatatattggttccttccagacagtgtttaaacaaagtacattcctctaaaatcaggctgttttttaaacaaaagaaaagaaagcacattaagtatgtctaaagacaccatgatacaaactattttaagttggaggtatgtgtgttttcttatggccgatcttgggcagtccatggcacagccagctactctgctgtgcagagacctcctgagttgcaaacactgctcacagtggcctggcgaccaggaactagaagcctagtaccacctgccactccctccctgggagctccaacaggcaccaactgcatgaggactcatcctattcctgacccaagacttaaagacagaagtaaccaggactcattcttgaaattcacatatggtcctccatctggcaccgggggcttctgctggtcagaaaagctatttctagatgggatcaacagttccccatccatcagccctgctctcggaggtcccttcgccaagttctcattgccagcctctcttactctgtcaacaatgcattctgagaatcccccaagcacgagagaacaagccttcacgtcagagagacccagagctgggaattcctcatacagactccaccaataggcacggtatcttctctctcctcccaccctgtacccctcccacctcactacacaaaaaccagaaacaggctacccatctgtgacagcgttgccaacacagtcatgacagatgagaaagtctcaccctcaagctgggatagacagtactgaactctcaagctggcatagagagtgctacgctgacagacaatgttgaactggcctatttctcccctgtgtgcatctgaacttctgcacacactgcatccatcccgattaacaatgaaaaagacaaaccctaaatcttttcacgccttctgggtcttccagcagattctccagggatgccgcccatttggctgtgctcttgaggctctggtggctgctgctggaactgccatcgctgtcgtggatgtctgcaaagcaaagttcagactgcatatgtggccaacagacactgtcattttaagaaatctgcatgcaatggtcagcactgccgtcaccatcacggctgacatacaccgacttatgcgtcaggctctgttctaggtgcttaacatgatggactcattcttgtcacacaaccctgtaaggcaggcactactatttcctccattttacagatgggggtaaactgaggctcggagggatgaagggacctgctgtttcccaccaaatccttcccctactcttgtgtccactggccaattcagaggcagccctcaagtcacactcaaaccctcctccaagagaaccttgattcaacagcaactgcttccccatggcgctttgtgcacagacttagaattatggtgctgtgttgtgactatttacatgactgactcccactagtctgaaggctcctatgtgtcctcatcttgtatctccagcacctagctcattatctggcacagagattaaaaaactcattgcaggacgggacccacgtgatggcgcaaaatgtcagagggttgccagaatacccaggcatcaagataaatgtcatttcaggcaatagctctttttgtttgtttgtttgtttttgacagagtcactctgtttcccagtctggagtgcagtagcacagtctcggctcactgcaacctctgcctcctagattcaagcgattctcctgcctcagcctcccaagtagctgagattataggtgattcccaccgcacccagctaatttttgtattcttaatagagacggggttttaccatgttggccaggctggtctcgaactcttgacctcaggtgatccacccacctcggcctcccaaagtgctgggattacatgcatgagccaccgcgcccagttcctcaggcaatactttttcaaaaaatcaaaatttatgctaaaaaatccatgatgaacaaaatacccaaattttaaataaagacaggatcggttatgctgatttttccttttgcttcagagtccaatatggctcagcatcacactgttatttttcctgactttatttaaacttcggatatttgttcattacggatgtttctgcattaattttgatcttttaaaacactgcattaaatatcatttataggctgggtgcagtggctcacacttgtaatcccagcactttgggaggccaaggcaggcagatcaccagaggtcaggagtgaaacctcatctctactaaaaatataaaaattagttgggtgtggtggcatgcacctgtaatcccagctccttgagaggctgaggcaggagaaacgcttgaacccaggaagcggaggttgcagtgagccaagatcacaccactgcactccagcctgggcgacagagcaagattccatctaaaaataatgataataaataaataaataaataaataaataaatatcattatcctgatgcctgaggtttttggcaaccctcttacattttggtgcacagagaaaatggatgaaaactctttgcatctgcacatcttccactgtactctctgactcacgacactgagaagtctcctgggaggaacagggaatctccaaataacacactttggccacttgcctgtaggaggagggaacaattaaagcatgcttcattctatggcatgtgatcccttcctggagtcaaggaagaaccatggaatgtcacttcagatggggccaggttcaaaacccagtttctggccgggcacggtggctcacgcctgtaatcctagcactttagggggctgaggcgggtggatcacttgaggtcaggagttcaagaccagcttggccaacatggtgaaaccccgtctgtactaaaaataaaaaaaagtagctgggtgtggtggtgggtgcctgtagtcccagctacttgggaggctgaggcaggggaatcatttgaacctgggaggcggaggttgcagtgagccaagatcgtgccactgcactctagtctgggtgacaagagcgaaactctgactcaaacgaaacaaaacaaaacaaaacaaaaaacccagtttccccaattcaaaactataggatcttgggcaaaattcttgtgtatatttgaaaatcatcccccatctcttgggttatcataaggattcaaaaatggaagcacatcaggcacctagcagcacacttgggacacagtagatgctcaacaaatgtgagctcctttcttcccatctctaaaataaccatctatcaagcaaactacttctataactaacacttttttccccattgactttttttctttccaaagctagagacatgtttctataaaaaaaagttcaaatctaggagaaaataaacttttaattaagaaatcagcaaggccgggcgaggtggctcactcctgtaatcccagcactttgggaggccgaggcaggcagattgcaaggtcaagagatcgagaccatcatggccaacatggtgaaaccctgtctctactaaaaatacaaaaatttgctgggcatggtggtggatgtctgtaatcccagctaccagggaggctaaggcaggcgaactgcttgaacccgggaggcggaggttgcagtgagctgagattgcaccactgcactccagcctggtgacagagcgagactccatctgattaaataaatacataaataaatcagcacagcaaaccacctctaaatgatatatttttttaaataaagtctcataaatattaattgctgcaaacagctagggggccacacagctaaaaatggttttggagaaaatctgtatcagagcacactggacttacttaatagtaacagctcctgtgatctctgatgttctatggggggtcaaaatacatgttgacttcttgatcccctgggactccaaatccaagcacctggggaaactaccaggattttagacattcaccagatgacatgagctaaattagaaccaggccagctgggcacagtggctcatgcctgtaatccaaacaccttgggaggctgagacaggaggatggcttgatctcaggagttcaagaccagcctgagcaacatactgggaccccatctctataaaatatttaaaaactaggctgggcacggtggttcacacctataaccccagcactttgggaggcccaggtgggcagatcactcaagctcaggtgttcgagaccagcctgggcaacatagtgaaatcctgtgtgtacaaaaaatacaaaacttagctgggcatagtggcatgtgcctttagtcccagctatttgacagactgaggcaggaggatagcttgagcccaggagttcaaggctgcagtgatccatgattgggccactgtactccagcctggatgacagcaagaccctgtctcaatcaatcaatcatcaataaagcagaaacccagaaacccagcagggaccatgcttcaatgctcattggcaatagagtacgtaagagaattatttgggacaaatcctttcctctaaccatgaaggaaactcacttaaacacatcaccaaatggagctgatgcttttctaaagtgaccctccagttcgtggatattaaattagttccctgttctctttgtaaatgctgcagtggcaagttcctgaacactgagtttctttccaacaaagtataaatccaattaaaagatcattattacaagaaatttctgcagcagggttcattctgccaagcattccactaatttactcttctgctctttgcccagagaatacagtttgacagtttactccatttccccagcagatcttctcttaagtaaataaatctagagacacaagttcactgttccaggaacaatctaggcagctgcaaatttctcttgccatggcagaaccactttggccataagttttcaaccttggtctgaaaggattccaaaactcttgacattcttttccataataaaccagaccatgtttgggttttcactgccacgctgtcttgcaaataaatacacacagtagattaccatttagccaacaaaatgtctgagagttaaaagaactgacctcactgttagacaattgccaacccccaccctttatttcatactctaatcatttttgcatattaggtttatgtgttcaaatgtgttttcatttgaacaaaaaattttacaactcaaaacacactaatgtggtccaggcccacctcccccaccacctcattttatagactgggaagcaaaaatccagaagatagaatgacctatccaaggtgatgcagctaatgaatcactggatggacccaatactgggacctgtatgggaggtcagctgtcctcaccagggccatgtctgcagaatcccagggctcctgggaacatagttagaaaaccgatgggcccttccattccatggtctcctgggctaagatctcccttatatcatatgccatgaaatacgttaacaattgacactattacagaagagcatggagttttcagggacgggtcagaaagtatgccaagatggagctgctttttatagccatgggtattggttttctggctatggtgctctagataaagagcaattccttcttgcctttttgctcaccttctgtccccataagtggaatagaagatccttctatctgagatacctgctctctatctgtcataagtttttattttccccaaaaatgttggtttgaatttttctaagacttcctgactgtctttcaagtttaaggcttttggctatggcaccccacccttttcaaatccatcttgactgatatcagtatagacagatcttgatgagacagcatttgcaaactccactcacccagtggcatctctcttttccaagtcactatccccagcctccaatatgactgagcagacagggatagcccttaggctgagggcacttctgcaactcagggtcccctgctcaggggacacactaagtaatgaattcctaagccatctcagctcagttacgacccgtgggcgcggtggctcatgcctgtaataccagcactttgggaggccaaggcaggcagattgcttgagctcaggagttcaagaccagcctgggcaacatggtgaaatcccgtctccacaaaaaatacaaaaattaggccaggcgtggcaactcacaccagcactttgggaggacgagatgggcagatcacaaagtcaggagttcgagatcagcctggccaacatggtgaaaccctgtctctactaaagatacaaacaattagcctggagtggtggtgcgcacctgtaatcccagctactcgggaggctgaggcaggagaattacttgaacccaggaggtggaggttgcagtgagccgagatggcaccattgcactccagcctgggtgacagggcaagactctgtctcaaacaaaacaaaataaaacaaaaacaaacaaaccaaaaaaaccacaaaaattagctggtcatggtggtatgggcctgtaggcccagctattcaggaggctgaggtggaaggatcactcgagcccaggaagcagaaactacagtgagccgatattgcgccactgcactccagcctgggtgacagagccagacgctgtctcaaaaaaaaaaaaaaaaaatcataaaaaaagaaaagaggccgggcacagtggctcacgcctataatcccagcactttaggaggctgaggcagccagatcacgaggtcagttcaaaacctgcctggccaacatggaatacaaaaattagccgggcatggtggcacgcacctgtaatcctagctactcaggaggctgaggcaggagaattgtttgaacccgggaggcggaagttgcagtgagctgagattgcgccactgcactccagcctgggtgacagagagagactccgtcttagggaaaaaagtttaaaaaaaaaaagaaaaaaatgttaacaaccaaggtggaaggggaagcaggttaaagtaagtaagtaaataaatacatatatacatacataaataaatgttacaaccagtccagtaatattagaagaaataaatactctttctcaatagcaaagcaggtttacctctgaacttaagaataaagcaaaaccaagatttcccagctgcccaacttctggtacctggatccacaaagttgcaatattcttctatcccttttcattgataaaagtttccatttcagacagattacacaagaaagcaggactgacatgaataggtggaaaaaatgtcaggcatgttctccagcagctttacgatctctccagctagggaagacctgcttgtgatatttgtttgtttcaattttatcatgctgttttatttttgttgtcattgtttacttcagctgtaaaacatttttgcaatgaataaaagtttttggtgtttcattttgttttcttagctcctgggctctttacgtcattttagatcttcaaattttttgcatgcaaaatacgtatttttcagcaaatttattttcagactactctgtcattagctaataataatggttaatacttcagatgggccaggcatggtggctcacacctgtaatcccagcactttgggaggccgaggtgggtggatcacttgaggccaggcattcaagaccagcctgggcaacatggcaaaaccacgtctctacaaaaaatacaaaaattagccgggtatggtggtgcactcctgtaatccccagctacacgggaggctgagacaggagaatcacttgaacccgggaggcggaggttgcagtgagctgagatcataccactgcactccagcctgagcaacaaaacaagaacctgtcttaaaataaataaataaataaataaataaataaataaataaataaataaataaaaaaggccaggcactgtggctcatgtctgtaatcccagcactttgggaggccgaggcaggcggatcacgaggtcaggagttcaagaccagcctgaacaatacgatgaaaccctgtctctactaaaattacaaaaattagccaggcatggtagcacgtgcctatagtctcagctactcgggaggctgaggcagaagaattgcttgaacccaggaggcggaggttgcagtcagccgagatcgtgccactacactccagcctgggtgacagagcgagactctgtctcaaaaaaaaaaaaaaaaaaaggttggcgcggtggctcacgcctgtaatcccagcactttgggaggctgaggcaggcagatcacgaggtcaagagatcgaaaccatcctagccaatgtgctgaaaccccatctatactaaaaatacaaaaaattagccaggtgtggtggtgcacgcctgtagttccagctactcgggaggctgaagcaggaggattgcttgaacctgggaggcggaggttgcagtgagccgagatcaagccactgcactccagcctggtgacagagcaagactctgtctcaaaaaaataaaaagaaaaaagaaaaacttgcaaatgatttacagtgtgctgggtaccgttccaagcttttacctgaattaaatgattcagttctcacaataacctactgacgtggttagtattatttccactttgcagacgaagaaactgaggcacggtaacttacaagcgtcccagctagaaaatgggaaatcacggcccaaacccaggtactcctgctccagagtacacgctctttaccaagggctctactgccatttttagcttttatatctgctgatctttatactcacagaggccagaacacaacagcctttaagagaccaagaacaatcacactttggggaaaaaacagaaaactgttaagagtccaatccatgcagaaaaaaaaaaaaaaaaagtcacataagaccaggtggaatcatccagcacacaaacacaatgtatatgcgttttccatttatgattatgctgtcctatgtggcttctggcgtcagtaaaagccattatttcaaggatgggtgaagcatcacagtgcagatggctggggctggttgcttgcagcttattttatgatgcattatttatagatgctatgatgtcatatctaacagagaccttctccagacattaattccttggaaatccatactcaaaaggcatctgtaacactcatcggagatgaatgctcacagcatggatttctgctgttaatttgcaggaaggtctgtgtaatcatcctgcatagacaatttctccaagtcaaataatattttagtaatatctcactatccagtttcctcaacagcagagtcaacttacatcctcagaaggtttgtcctaagtactcccccaaactcacagactattaaacattcgagtccaggaaaaggcagagatattaaccctaaattccaaagtggtttggtacaactcacatgcacaggcgtgcacacacacactgtactcctttaaaatactctactttgtaatgaagtttcaaagaaagtacacaccccacaaaacttatttaaaacctcttgtcacctataccacatcaagtgtagtacattttttaaaaagtcctcccaatttagaatcagagagtcattttgttacaactggtgatctgtgtaaggctccagagaaactgggtcatggaaacatggtatctaaatattacttaagtgtttatcggctccagtatctagctgctgagaataactaccccacctgcatgcaattcccttgccagagagatctgattgaactgcagttagcaggaaataacatcaaaagtgaaaaaagtttttcaataatcatagtaatagccagcatccaagtcaggagcaggaaagctggtggcagagggttggctccactcagaaagggcatcgtggcgttttcacacgagggttcgggactcacagaaagccaagtgctcctactggcccttccacagtcacctgtgcacctctgtgtcctcacagcacactcttcccagcccctgccccgcccagggccaaggcgacaggcaaactgcggacatggaaaggggtgggggcgattccttacgttccatgctctggtgtccacctgagaagttccacgcagaccaacaatccactgccttcccagagacgccttgtgtgagaaaggcagagactggagggctcccgagcacccttgggtccgaagaaaaaacaagcctcaacatcctcttttaagtggactaaacaacagatggccactggtttccagtttctactagagggaaggaaataagaacgccaaactgttatttgtagcctccctagactctccactttctaggcaaagtccagaaaaaagaaaatggcccagcagccctagcccgaaaacaaagaccctgtcatcgattttctccacttccagaagcccctgtgtgtcctctggggcctgacatttctgcgtaaagctgccctcaccctcctactctgcctcaatctgtcccgcaccctccctcgaggcaaagtaaatgactttttcctccagggtcagtcaggtggatggtgcatttcttgaaagcaagggctgagtcttcctcagggtcagcatgatgtctggcactcaagtatatattttatagtgataaacattttctaaggaatgagccaagccaggcaccaggctaagggtagagggcacagaaaggaggacggatagctattaaaaatagttgaggccaggcgtggtggctcacgcctgtaatcccagcactttgggaggccgaggcgggcagatcacctgaggtcgggagtttgagaccagcccgaccaatgtggagaaacctaaaaatacaaaattagccaggcgtggtggtgcatgcgtgtaatcccagctactcaggaggctgaggcaggagaatggcttgaaccccggaggtagaggttgccgtgagccgagattgcgccattgcactccagcgtgggcaacaagagtgaaactccgtctcaaaaaaaaaaaaaagaaaaagaaaagttgacatttactgagcacttactatatcccatcgaaactttgcaacaatccttgcaagctagtttcctcaagggccccattttacagatcaggaaactgaggcacagagacgataaataatttgctacaaagaagcaagcaaggaagtggatgagctgggatgcaaccccaggttgtctggctggagagaaaaacacagagaaagatgccagaaatgaaaggtgggggctattttctcacagaacttaaaatgaattgaggagaggaggccaggggttcccaggtggccgcctgcccacagtgccacgggctggtaggcggttttcttcactagtccacaaataaacgagaaggaagactaggaaatatttaccaagtgaactgtgctggtagaggaaggacagtcttgggttgcttgttttgcttttgctttgaaatagatcactatgtttctttacgtggggcacagtgcaggacatacaaaagggagtgtggtgtaatagtcttcctcacacctctgtccctcaggtgcccagtgtctctccccaggagcgacaacctctacaagattctgtggatcaggacagctctttacctgagattatatctttcctactattgggggtgttaaaatgtccttttctgtgtgaaatgataaaggtgtttgatgatggctttgtttgtttctaatgtcctgactacagaaaagaaggaagggagggaaggagggagggaagaaggaagggagggagggagtggaggagagagggatggaggaagggaggaaagttgtcagctccacattcattctctaaatatattttagcaaagtcgctaaatggttgttgtgtttaggtggccgtggacttgggtccaagacttgagttctctgccccttcagaaatgggtgcctccggacaagtccctgccccttagtggcctctgcagcccttgagggagaaatgaaatggttccctcctgctcagacaagctgctctgtcaagcatggagggtgggaggcagcgaggcctagaagggtgggtctgttggagcagggggacccaggctttgggacaggacaaaggacagctgggggagcaaaggcacagagggagtattgtccagtccctccaggggtagagtagggagcaggaaaaatggggctgggaaggactcagtcagataaggggtcccccaccaggcagtggggcagcaaggtggacctgagggagcttagcagggctcttgacagatgggaacttgcttggaagggaaatttgtccccacaagtctgcaagggactgtctcactccagcggatgccgcctgacagctcttatcaaggggccactgctgctgcctgctggggccccctccgctcctgctgccacccgcaggctgctgcagcaaagaactatctgggggaagcagaagaaacttgggggcataaatttagtgcagtttaagcaacaggttcccagagcccagcatctggggactcactccacccagggagggaagtgactcagttcacccaggaagccctaggaaatggccatgccaggcatctacattttctaaccatgaagaaaggagacatcacatcaaatacaaatcagccaacagagataaaacaccgtgagcacctcacacccaccaggctacgggctgcactaggtggtgcccagagcaggtcccagaggctcaactggctcataagctgaccacacctatagaaaacaaggcccttcggctggcccctctgtccccccaggcctgggccagtgatattctgcagagaaagttgtcccagctgccaaggctaccctgctgccgagttgttaaaacaaagacattaaattgctgtgcaaactgtcatctttaaataaaacaagcccagccataaacttaaaactgttcccaagggtttaatcggatcctgtatgacaggcccgaggggacggccgaaacctgcccggcagggtgggaattcccctgagaggtcacccctgggtgcagctgcaggggtagggagtcgggtggcttcagcttggcatctcagatgggcatatttcagctatcaacaatgcaaggttgataactgggcagggtgagtggacagaatcccgttgggggaccctcacatttcactggcctgagaattctctggggtgcttgtcaaagacaagccccacctacagtccccaacactgaatcagtctgggcaaggcctgagaagctgcactttatcaaagccctcctgaacccacaggacgggtggaacacactttgagaaacctcaggaagaataaggaaatcccactctgaaccttggaaggaggggttaggaactcaaaatcctccgcggaaagacagtgtctccagtgagattttgctgaaaggtaggaaaagtgtaaaatagaaggtactgggggaggcaggaccacagccaggtccaaatcaggggtcctgcaggagcagctctggcttttgtggagcctgaagtttatacaatttgaggatcctctttaagaaaaataattcaaaattacaaaaaaaaaaaaaaaattaagtacagggtcccaaaaatcacttggctgtcttctcagtacctcggcccacaggcccaaatgacccctttctcactaggcttcttcttttcacacggctgggtggtgatgaccagtcaggcaagaacttatgttattttccataatggggaaagaccctacacctacaattccaaagaaaatcaggctattggagtggaggcatccagtaccaatccatgatgtttagtggctgatcttccttccttccttccttttttcttccttcctcccttccttccttctttccttttctttggatctcactctgtcacccagggtgaagtgcagtggcacgatctaagctcactgtagcctcaacctcccaggctcaagccatcctctcacttcagccgtctaaggagctgggactacaggcacgcatcaccatgcctggctaattttttaatttttttgtagagacggggttttgccatgtttcccaggcttatctggaactcctgggctcaagcaatcctcctgcctcagcctcccaaagtgctgggatcacaggtgtgagccactgagcccggcctgagaccgacctttctgtcagtgatgtaaccacattttatgaggtttaaaatttgttgccctgaaataatttgttccctaaaactgccttcagcctttttggggtgcaacctggctacacgcaaaatcaccccaaatccatgtatctcccaggatacaatggttctatctgtcagtcttcaacccaaaagcaatctaaagtaataagtaacgcgtacagggctattcatagcagctctatttataacaggcaaaagggagaaaagctactaattattacacttttattatgtgccacacattgtactaggggcttcatatggttttgagtatttaatcccataaccctatgaaacccactttgcaggtggagaaaggtgctggaacatcagctctcctgagtcaaaatgaagccttcatttttagctttgttgattttcatgatgtaaatatcccatcataactactttcaagctacctatggtttacaaccagtttccaaactttttgaatatttggcaactggctcttgcaagccagtttgagccagctccagcacatcactgaaacggaggcacagagagatcaagtaatttgcccagtgttgctgaatgacagagtcaaggttagaaccaagagtttaattcgagtccaggctctgagcagcgctccacaggcctgtgccaaccatagagactggttaacattaacacccacaagggaattctttgactcacatgcaacacaaaaaggtttacatgaccactaacgctaacggagcacttagtacttgccgggcaacaatgtaagatcattacaacaaccctatgaaatcctacatattaaatacaataatttgcaaaacctgatggatggaagacaggttccaattaagtactttaaaaggcgagtagctactgttattcccactgtgcagaacctcattctgcagaaaggtcccacggctggtgaatatggcgaaggtgagattcggatccagccagtctggtcccagtctctaaaccacaatgtccctcataaaataccaggagcagaaaggaaatgcaccaacgcgttgggactctgagcgccaagcagaagtgaatcttggcgtgggaagcccggcaaagcccccgaacttcagagtcaggggaacctgggtttgaaagcctccccatcacctgcggagtgtgactggggcaagttacctaacagcgcctggcttccgctccctcctcactcaccgggttgtcctaggggtgaagggagagttcacccaacgcggtggacaaagcccttggcgcacccaaaggcctgcacaggtcgtagctattgtgatgagcaaaagggtggaaggaccggaatcaagggcacggctccaccttcaccgtggggtctttggcctatcaagttgcccgagatcgtggctcaggctggcccaaagtgacggccaaggcgaatccttcgtaacgtcagaacttcgctggctcggaccgcagaagtgcccttctccatcctggggttccgccaccctcgcgatcccaccttttggctcctcgcggcagaagcgaaggcccccgacgccccaggcccaggggcccagtcggatgcccgggtccagccgtgctcccccgggcgctcggcatccttccacccacgcccgcagcggaggcggagagcgtcacggagggagaagcccgcgcgccgttccgctttcggaatctggagccccatgtcacctccaaagtttggagatttggggcgctcctttttctcccagaccatcactaaaaagaaaactgcggctgttcctctttcagccaaacttcctccccggggctcccggaggagctctgcgctcccgtcgcggctgggaccgcgaaggtgcggtacccagcggggagaggtggtgcggtcggccggggctccagtctgggaggtaccaccgagccgcgcccgagcacaagagggagggcaggaggccgggcgggcgaaacggcgccccgaccccgagcccgcgggcccccgaagccgcttacctgacggcggccgcttcctgctcagccggctcacggcgcggttgaacatcgccgcgggcgcccgaggaggaagaaggagcagcccggcggcgcggcggctgagccggaggaaggcgaggaggaggaggagggcgaggaggaggaggaggagggcaaggaggaggagcgggctcagcaccgccccggagctctaggtccccgcccgccgccctcctcctagccaggcgccgcgtggcgcgctcagtgcgccctgcccgcccccgctggtgaggactcgcggttccgctccggggtgcccgggcggggcagggcagggcagccccgggtgacccccgatcgcccagagtgtgccccgcgcctgggataaggtgcactggcccagagggagcccgcgccgccgggaacttagtagccccgcggaggcggttagcgcgtcccggggtccctggccctcgcctgagatgccgccccggcccgccccgcccagcttcaagctcccgggcccatcgcggtctcccgccttctccctgtagccccggagaaactggcacggcgccgcgggcgcaccgcgcttcggggctctcagcgagccttcgcaggtggcgggcggggtcccctcccgggtcacaggctgggaagcctaggcctcgcggttctgcagagtccgggcgcggcccagcctgtggcctttgcctcctcgtcaccaggatccccgcctgctggggcctggctgctcctcgacttcgtgggcgctgcgccttcccgccccgcgaatgcgggtggggcgtccccagggcccgtgcgctgagctagccgagccgccgcgggtgggcgccctctccccggccgtgccgcgcgggcgccaggactcggggagatctgagaggattctgcaggaaccccccggttcctgcgccgggcggtgctctgtcccgcacaccgcgctctcgggacacttctctaactttggggacacgtgggcactgcctctggcagggccttcaggctccacgaccgggaccactcaagcccccacggcgtcacctgctgggcgctgcgcgctctacggtctcctattatttcatttcttctatggagcagccccagaggggatgtcattagcccccattttcttgaacatttggtttgcaagaaattgtctttctggcgagttttatttttctccttgtgtatctggctttgtctctaaattggtctttatttttagctgtactaattgctatttttccaaaccgttccccagtcgccctccccccatccccccgtccttttgcagtttttttcactacttggcactttcttttgtatcttctattctgagcttccagttctgctcactttccctctccctctacccaccccacagccccagttgcaccccaagtgtggccggtggttgcttgttgtttccctccccgctattccccctccaaaagtcgttttcctccgagcatttccaagcactctcccccttctgctgccaaaagaggatttccaggctcctgaagcgaacgcggtgaccaagaacagggttagacccagcgcggggagttctgcttttaaaactgctgttgttggcctactccgggcccagacaaacttccatctcattgtaatgggatcaagctgtgatacttaactataggcaagagtttcacctttcgtaagagcgggattttaaatgctggcagagtcctggatccaagtgaggtcactgcgttcttaaaacaataagggaattggtgcaacgcactcacccagaaaacttccccgagaccaaattacaagtaatcctaagacaggaaataagcacactggcacacaggggtaaaagttaggcacagcagctcagtgttttgctagttgccaagtccaccctagcgtgtcctgaaaaacactggtgtggcttaagacatgctatgaatccctcctgagctaagaaccccaggcatctcttaaataaagggaaaatataacagccttaaatcacttttactgtcctgttagcacatcagagagtaagtacaaaaattaagatgcatagttagggccaggcgctgtggctcacgtctgtaatcccagcactttgggaggcagaggcaggcggattacctgaggtcaggagttcaagaccagcctggctaacatggtgaagccccatctgtactaaaaatacaaaaattagccaggcctggtggcaggtgcctgtaatcccagctactcaggaggctgacacagaagaatcacttgagcctgggaggaggaggttgcagtgagccaagatctgaaggaggaggttgcagtgagctgagatctcaccactgcactccagcctgggccacagagcaagactctgtctccaaaaaaaggaaaaaaaggccgggtgcggtggttcacacctgtaatcccagcactttgggaggccaaggcgggcggatcacctgaggtcgggagttcgagaccagcctgacgaacatggtgaaacctcatctctactaaaaatacaaaattagccaggcgcggtggcaggcatctgtaatcccagctactcaggaggctgaggcaggagaatcgcttgaacccgggaggcagagtttgcagtgaactgagatcgagccattgcactccagcctgggtgactgagcaagactccatctcaaaaaaaaaaaaaaaaaaaatgcatggttaacgtttaagtgcacagtttaaaatttttgcctgggacattgaaattgctataaatacctgttttaagtgtctgaaggttcaaaagccagttttcaaagtgtattgtgcaaaagaccacgtataaaagtataaagcctcctaactcctaaaactcgccaaatgcacacacacatacacacacacactcacacacacacacacacacacacacacgattaagttccaaccgtggtttgcattggattgaaggtgctcaccatcccaatggcatttttcctgtaattccagcatgcactttctgaagcttttttttttttttttttttttttttgagacagaggtttcactatgttgtccaggctgatttctgacttctgggctctcaagtgatcctccctccttagcctcctaagtcaagccttcacaaacaaactgcggtagccagtgtggggaagaagaggatgagcggtttagcccctttcttcccctgctggtctcacttttggttcaaggatgtttacatcaggcaagaagcaagagccccggatgtcttctggtaacacaagatttcagagggattactggctttggagttcaatattttcattctacccagaaactaaaatattggtaagctgtgaatacattttagagcctctcatcaccagaatttatgtaacaagactattctaggccagttgaggcagacaaggtatagtaaaatgaataagtggccaacttaaagtcaagagacctgggtactaatctgaccaaacagcaaccagctgtgtggacacaccagatgtgtcctcaaacacatcgtagcctcaagggacagggcaaggagaggtccacctacactccgagcaagtggtattcaatagcaataaacaaaaaagcatctggcatcgtgcccagcacatgtaggcacacaaaaaattactggaattttaattactcttactccccctacaatgatgttttaataaatgataaactttatggtacagccagtcaaaagtggatttcttttcaattataggaaattggcagggttagtaacactgatgttcacattgttactacactgtgaaggagggaaagtaaattgttacaacctctctagaaggaagagaagcagatgtgttaatatatgtatttgacaacacatgtaagagtcttcaaaatgtttatacctcttggactagtgaataattctataattggtaatttgtgccaaaagaaaaacaataaatgatgcgaacatttacgtgtacaattaaacataacacttccttttatcagggttatttacagtagctaaaaatgcccgctaagagaatgactaaggtataacatattctcctgatagaatatttaacagttataaaaaactgtgaagaatctttggaacttggtggaaaaaactagtgcaaagagaaagatgaaagaatcttagacgaagctctcgttgaaaaatcaggatacaaatatagagaaaattttcagtgtggaggaagaggagaatacggtatgtttatacctagaaagctagcagttaattacacctaaatattactagactatatctctagataataggataatgggttcttttttcttcattacattttcctgttttgcaaacttctgcagtgtatgtgcttttaaatcagggagaaaaatcactaattagagactagttgaaatctctactgggtttaatgccacaaaaatacataaggcttcatttctgttgcagttttgtgttttgttttttagagacagggacttgttctgtcgcccaggctggagtgtggtgctgcgatcatagctcactgcagccttgaactcctgagctcaggcagtccccctacctcagtctcctgagtagctagggctacaggagtgcaccaccataccctgctacttatgtatgtacgtacgtatgtatttatttattcattaatttttttatttttaattttgtttatttatttatttatttatttgagatggagtctcaaataaataaatagagatgggatttcaccatgttggccaggctggtctccatctcctgatctcgtgatctgcccacctcggcctcccagagggctgggattacgtaagccactgcacctggcaaaagtaaattttatttttagagcaattttaggttcacagcaaaattgaacagaaagtagagttccacatgcctcctgccccaaacacgcatagcctcttatagcatatgacctcccacaccagagaggtacctttgtgcaatcaaggaacctacaatgacacatcgttatcatccagagttcatatcaaatacccttttcccatctcaggactcccaccttttttggagggtgtggggctaaggagcagaaagtttaatacgcaggagtaagagaaaggagaacagttctctctctagggagagagaggggcttccgaaaggaaagaccaacagtggtggggttcactggattttataggcagacttgagaaggcggtgaatgatttacatagggcccacagattggttagatcagatgtgacgtttacaaagcgcccagggaaggctggccaccccaccctaatcttactacacaaatgagttttccacttgactggtgacatcttgtctgctccttatacacatgtggctggcaaagacaagggaagatggagccgccattctgaacatgcctagtcccaagtagctttttttctgccggcattcacccgtgcaagcatccagcttgcttgtctatgtctgcagccgggcgtggcggcacatgcctgtaatcccagctactcgggaggctgaggcaggagaatcgcttgatcctgggaggcggaggttgcggtgggccgagattgtgccattgcactccagcctgggcaacaagagtgaaacgctatctcaaaaaaaaaaaaaagaaagaaaagaaagaaggaaggaaggaaggaaggaagggaggaagggaggaaggaagggaggaaggaaggaaggaaagaaaagaaaaaggagacaacaatgggagagagatttcagccaatcagaaaggagatggagaagcagaaacacttaacaagaggaaggagctacaacctaaatgcaggcagggcgtgccagttagaacaagccaattcaccctgcagagcctcagaggagctcctgacccaaaggcacagaccacagagaagaggacaggcaaggactgaaaaggggagattgatagaagtctatataaggagacttcagttcccctgccacctaccttaggaaataatgatcttgggaaatagtgaagtacagaagctctggacttatgaactactggctgagctaaaggtgcagatgagctgtgggcatcaaagagagtgttaagcctagatctgtacacaggattgggaggcccttcttcctcagccccttccccagcagccagatgtactagaaaaatttactctctccaaaacaaaaaacaaaacaaaacaatggaaattaacatttaacgttctccagagttagcactggccaactacacagacatacacaatccacatgcctctttcacacacacagttccaaagagctttggacacctccttctcaaggatgaggactatgcaaagaccacagacatttaaggaacgtctctaatgagagagacagagagaaatagaaaataggaattcaggcgaaagacaagagagaataggcatgaatcttttaaaatactataactagctcagagagggagagagagaagctatttcatccattcataaaagaagaaagattggaatataaaaatgaagtagaaacaaaacatttcaataaaggagtttgaagataaaggtgaagaaatctcctgaagattagagcagatgaagaaatgtacaacaggagagaaagaaagaaagattggagaatcaatccaagtaataggagttccagaaagacattacagagaaaatgttagagagaaaattaaagatataattcaagaaaattgcccagactgagatgggcatggtggtgtgacctgtagtcccagctactcaggaggctggggcagctggactgcttaagctcaggagtttgaggctgtagtgtgctgtgatctcacctatgaatagtcatagcactccagcctgggcaacatatcaagactccatctcttaaaaaaaaaaaaaagaatgaatgaaaatttcccacactgaagaaaattcatctccaaaagcaaagagtccataacgggcacaatgtgagacctacaacaaggtacacctgcataaaatttcaaaacaaagacaatttccaaaaaaaaactcagaaagagcacattggtggtgggaatactaaatggtacagccactctcaaaggtgacttggaagtttcttaaaaagttaaatacatacctatcatatcatccaaacattccactcttaggtatttaacccaagaaaagtgaaaacgtgtccatacaaaaactcttacatgagtgttcatgccagctttagttgtcataacctggaaacaacccaatgtctgtcagcagctgcatggataaacaaattgtggtataaacatacaaaagaatgaattattgacacattcaaaaacataggtaaatatcaaaataattactctcaatgaaaaaaaaaacagaccaaaaaagatatatactgtatgatttcatttatgtaaaattctagaaaatgcaaactaaactatagtaacagaaacagatcagtggttgtttgggggagaatagggagtaggggtaggggagtgatagaaaggatggatttctttttgtttttttgagacagagtctcgttctgtcacccaggctggggtgcagtgccagtggctcaatctcagctcactgcaaactccacctcccaggttcaagcaattctcctgcctcagcatcctgagtagctgggattacaggcatatgccaccatgcccagctagttgctttttttttttttttttcttgagacggggtctcactctgtcacccaggctggagtgcagtggcatgatcttggctcactgcaatctcgcctccctggttcaagcgattctcctgcctcagcctcccgagtagctaggattataggtgtgcgccaccatgcccggctaatttttctgtttttagtagagacggggtttcaccatgttggccaggctggtctcaaactcctgacctcaagtgatccgtctgccttgacctcccaaagtgctgggattacaagcgtaagcgatcgtgcccggcccagctaatttttgtatttttaagagacagggtttcgccatgttggccagggtggtctcgaactcctggcctcaagtgatctgcctgcctcagcctctcaaagtgctggtattacaggcatgagccactgcacccagctgaaaggatggatttcaaaggggcatgaaggttattttgagttgacatgttcactatcttgactgtggtgatggttttgtaagtgtatacatgtcaaaacttatatagtttatatatgtgcattccattgtatgtaattttatctcaataaagctgtttgtaaaagtatgtatgtgctgagaatgtaaaatgatgcagcccctttggaaaacagttgggcagttcctcaaaaagctccatgtggagttaccatatcactcagcaattccacttctgcatgtctactctagagaaatgaaaacatacgtccacgctaaaacttgtacacaaaggtccatagcagaaaagcagaaacaacccatgtccatcagctgacgatgcacaggcaaacctggtagctctccatctattacatggaatattattcaaccataaaaaggaatgcagtactgatacgctacaccatggatgagcctcacaggggagccagtgatcacctctaataccccttttggctcttagtgggctcttcagctggatctagaaaccaaactgacaccaagctgatcaacaagagcgaagtatacacattttattagtttggcatgtacgtggagatcttcacaagagactcaagtctcaagtggctaaagcaaaatgctttttttctgcatcacttggactacacagagcaagatgcttttatactttttagacaaagaacaatagatttgaggaggaaaaaataggacaaagaaaatctggcaagggcgataaaatgttctaggagatccactaggagatacaggagggggtgtaaataggtggaagataagtgttatttcatgaagtatgtttattcaggtccattgccgtcctcagttccagtctctggtgataagggctattttctctctctggtttggagaggggacccctcccagaggaatctttaccgcttgatgcatgcaggaagagggaggtcagctggccctttctgaagccaccatttctccaatgtttgcaacttgaaataatcgatataccaactaggcatattttggggtggcgcgtccttcatgctctcaaccttgaaaatgttacggtaagtgaaagagtatcacagagagcatcccatgctgcatgattccatttataccaagtctagaataggcaaatctgtagagacaaaaagtaaatttgcaatctcctaagcctgggaacaagggaagaaggggaatgactataataggtacctggtttctttttggatcatgacaaagttccaaaattagattatgttgatggtttcacaaccccataaatacattaggaaccatttaattgtgtgctttacataggcaagttttttggtatataaattctatctcaacaaaactgtttatttacaaagagcaaaaacaggtcacatacaaaggatcagaaatcaaaatgtcactggactttctggaaagctagaaagcttgagggatatcctgaaaaaaaaaaaaaaaaaaaggatcaggtgcagtgtaatttcagcacaggtgggtggcttgagcccaggagttcgagaccagcctaggcaacacagtgagaccctgtctctccaaaacaaaaatacaaacattagctctgcgtggtggtgcatacctgcagtcccggctcctggggcgggggctgagggctgaggtgggaggattgcttgagcccagaaggttgaggctgcagtgagccgagatcatgccaccgcattccagcctgggtgacaaaggaagacctcatctgaaaaaataaaaggagtaaatgcaaaaagagagggcagcacaggctccagagaacaagggcccaacctgggagagcagcagagtcctgatcagggtaacaggagtgcagtgggactatggcagcaggtgctgggggaagcacgagagaagcctctagaagcctcctttgatgaccttgaatttgagaaactgtattgaaaaccatttgattctaccaggcgtggtggctcacgcctgtaatcccagcactttggaaggctgaggcgggtggatcacttgaggccagaagtttgagaccagcctggccaacatgacaaaatcctgtttctactaaaaatacaaaaattagccagatgtgatggcttgtacctgtaatgccagttactcaggaggctgaagcaggaaaattgcttgaatctgggaggcggaggttgcagtgagccaagatcatgccactgtactccagcctgggcgacagagcaagactctcaaaaaaaaaaaaagaagaagaagaaaggatggaaggaaggaaggaaggaaggaatgaacaaaagaaagaaagaaagaaaaagagagaaaagaagaatcagtagtatatgcatattgttcagatagatggaggcaaatactagaagaacagctgagaatgaaagatgagtagcttttgaggagtaggcctgggagaggagggtgaaagggagtgctggggttttttgttttgttttgtttgttttattttgttttgtttttcagatggagtcttactctattgctcaggctggagtgcaatggtgagatcttggctcactgcaacctctacctcccgggttcaagcaattctcctgcctcatcctcctgagtagctgcgattacaggtatgcaccaccactcccggctaatttttttgtattgttagtagagacgggaggtttcaccatgttggccaggctggtctcgaactcttgaccttcgtgatccgcccacctcggcctcccaaagtgttaggattacaggcgggagtcaccacacccggctgggagtgctgtttttcataagacttttagtacactttggctttttagactattatacagatatattattttaatgaaaataaaaattaatttaaaaaagttctagtagtcaccacttgcctagtccataacaaaagagaggacttggtggtatcaccaataatagtaacagctaaatttcactgagtactcactatgtacttggcactgttttatcttatcttttaatttttaacatttttctagaaatggagtcttgctcctccacccaagctggagtgcagtggctcagtcaaaggtcactgcagcctcaacctcctgggctccagcgttcctcccacctctgccttctaagtggctgggactataggcacatgccaccatgccaggctaattttttacttttgtagagatgtggttcttgttttgttgcccaggctggtctcaaactcctggcttcaagtaatcctcctgcctcagccccacaaaatgttgggattgcaggcgtgagccaccatgcctggccccaagtactattttagatactgttcttattaaacaaccccttggaggggccttaatcactaccccaggttgcctctaatggcaggcagaacaccaattgtaagtgaaattacagttcttcatggattgaaaagtaccacttacagatatattctttggatcatcactaaaccttgtgatataggaatttatagctggagaaactgagtctcagatttggagaaatgctcaacagcagaggtgaaagtgaaaagcaagaattcaggtctctgggctcctggtgccaaatctttacataactgcacccaaatccatgaaaaacaaaaaaaaatttttttttttttttgagatggagtctcgctctgtcgcccaggctggagtgcagtgacgcaatctcagctcactgcaagctccgcctcccgggttcaggccattctcctgcctcagcctcccgagtagctgagactacaggcgcctgccaccatgcccggctaatttttttatatttttagtagagacggtgtttcaccgtgttagccaggatggtctcgatctcctgacctcgcgatccacccgcctcggcctcccaaagtgctgggattacaggcgtgagccaccgtgcccagtcaaagatattttttaaaaatcagtttcaggtgtttgctttgtaaattgctccctcctgctattttttttttttttcagacagagtctctggagtgcagtggtgtgatttcgactcactacaacctctgatttccgggttcaagcaattctcctgcctcagcctcctgagtagctggtattataggcacgtgacaccacacccagctgatttttgtatttttagtagagacggggtctcaccatgttggccaggctggcctcaaactcctgacctcaagtgatgcacctgctttggcctccaaaagtgctgggattacaggcatgagccactctctcatgttatttttaaatgttaaggaaaaaggagtttacgatttccaagaatcttcacccagttcttctttcaaatctagatacaggccgggtgaggtggctcacgcctgtaatcccagcactttgggaggccaagatggatggatcacctgaggtcaggagtttgagaccaggctggccaacatggtgaaactctgtctctgctaaaaatacaaaaattagctgggtgtggtggctcgcatctgtaatcccagctactcaggaggctgaggcaggagaatcacttgaaccggaggggcggaggttgcagtgagcccatatcaggccactgcactccagcaggggtgacagagtgagacgctgtctcaaaaaaaaaaaaaaaaaaaaaaaacaaacttcaaatctagatataaaaatgtcctctgaaaagcaaaacagtgtacatgtgcacacacactccacagacacccacacatgtaaggtgttagtgtaacatgttaacactgttctggggtgagtgggttgtttgttttaaataatcacactgaaacacacacctcccaagagtgtcgtcctattcagtgtaatcactcacactccactgagtcaactgagcagctaccactgctcaggacttctcccaagcttctttggaatgtcactcacattctctcggacatttctagaacaatattttgtggacctaattggtttttggaaactgccaaaaaccattggtgaaaattggcagaataaggtgggtgataactgttgtgaaatgctgggaaacagggaggggtgtatgagacagagttataaaatagttgggccaatttactggtgtgccatgtaaatcatgcttgaaataactttagaagaatcagcatttggggccaggcccgatggctcatgcctgtaatcccagcactttgggaggctgaggcaggtggatcacttgagaccaggagctcagactcacctgatcaacatggcgaaactccaactctactaaaaatacaaaaattagctgggcatggtggctcacgcctatagtcccagctactcaggaggttgaggcaggagaatcacttgaatctgggaggcagaggttgcagtgagctgagatcacaccactgcactccagcctgggtgacagagcaagattctgtctcaaaaaaagaaaaaaaaatcagcacttggcaagaggattacagatgactagcttttagggcaaacagacatttcccattttggatatgtgtctagcatgattaaaggaggctcactttataaaagcagtagttacattactaaagtttatggccaccatatatacacctacgaatgttccttactattaataaaaataatagaaattgtgtgaactattataataagccccacaagacagaattcaattcaaaaaaattgttttaactatgtttttaacctaagcctattcacttacatttctctgatgttgaaaaatataaaagtctttagtggtttttatcaaaagtcttctggttattcatctatacttataaacaaatctcaaacactttcaatgctttttaaaatcataaaacccaactgagaaatagttagaaagtaatcttcaaaagatacatcacttatcaaacattcttatttatgatttccaaatacattttatcagccatcaaatttcagctaaaggctattttccacctgtttaacatgtggttataggaaatatctcaaaaaaggtagtaaacctataataaaaatcatctgacaagaatgcagggactggcacgcaccagtagtcccggctacttgggagactgaggtgggaggatcgcttgagcccaggagtttgaggctgcagtgagctatgactgcaccactgtactccagcctgggtgacagagcaagacctcaacttaatttaaaaaaaataaaataaaattcagggtctgaatattatgttgttcttgctcaacttttaaccagctggaaactttccagaatcactaattcctagatatacactgctcatgttctcaggaaatgtattttggctcacaagtttgatatttttatcaggtattaaaggaacattatatgtgttattattagtgacacagataattttacaccctaatgagaaaagctgaaatcatatataaagccataactcagattttgaagatatttaggagaggaaatatatatgtgtgcatgtatgtatgtctatacacatgtgcatatacatatatgtacacatatacacacatacacatgtgtgtttatctatacatatttaaagggatttgtaaacaagctgaaaagcggtgagagtcactggcacagcagctatgtgagcacactttagagacagcctgcatggcttacctctgtcaagagtaggcactaatgggctgggtgcagtggttcatgcctgtaatcccagcactttgggaggcccaggccggcggatcacttgaggtcaggagttgaaaccccatctccactaaaaatacaaaattagccaggcgttttggtgggtgcctgtaatcccagctatttggaaggctgagacaggagaatcgcttgaacctgggaggtggaggttgcagtgagccgagatcccaccactgcactccagcctgggcgacagggtgaaactccaactcgaaaaaaaaaaattaataattcctaactccacagagatctaaaaactaattccgtagagatctggcaattgtcagatgcaaagttttaagcccaaagacctttccataaagaagttacctttatggaaaggtaacttccacagtggctcacccctgtaatcccagcactttgggaggccgagacgggtggatcgcctgaggtcaggagtttgagaccagcctggccaacatggtgaaaacctatctctactaaaagtacaaaaattagccaggcgtggtggcaggcgcctgtaatcccagctactcaggaggctgaggcaggagaatcgcttcaacccaggaggtggaggctgcagtgagctgagatcgtgccattgcactccagcctgggtgacaagagcgagactttgtctcaataaaataaaataaaataaaataaaataagttacctttatgaggaggaaaatgccacaaatttctggttatcaggatcattagatgatccctattgataaagacagaatccattaacagtacttagctttacatgcctccagtcataaataccaaaatactttctttaataactataagtcccatatatttacataataggttatagagtgccattttgggtccagtccatgttttgaagggatttataaatacaggtaaaacgtgctgccagacattatttacaacctaaaacaatctttccagctgggcctagtctgttctcagccaccagtaccctcaaccttttttagtcagagtcactagaaagttttttcaccctgaacgtaaacagcagtcaattctccaagtgctcacataacatccttgactttacaggcgagatgacattatggcaactgaagactgaagattggtgttggctacacttcgcaggcacctggcagctaataatattgttgaggttgctgatccactttattccttcatgtccattatttttatgacattacattaaaaataccagattacagatatggtctcactctgtcacccaggctggagtagagtggcacgatcatagcccactgcagcctcgaactcctggcctcaagatatcctcccacctcagcctccttagtagctgggactacaggcgtgtactgctgcacttggctaattttttattttattttattttattttattttatttatttatttatttatttattttttattgatcattcttgggtgtttctcgcagagggggatttggcagggtcataggacaatagtggagggaaggtcagcaggtaaacaagtgaacaaaggtctctggttttcctaggcagaggaccctgcggccttccacagtgtttgtgtccccgggtacttgagattagggagtggtgatgactcttaaccagcatgctgccttcaagcatctgtttaacaaagcacatcttgcaccgcccttaatccatttaaccctgagtggacacagcacatgtttcagagagcacagggttgggggtaaggtcatagatcaacagcatcccaaggcagaagaacttttcttagtacagaacaaaatggagtctcctacgtctacttctttctacacagacacagcaacaatctgatttctctctttccccacatttcccccttttctactcgacaaaaccgccatcgtcatcatggcccattctcaatgagctgttgggtacacctcccagacggggtggcggccgggcagaggggctcctcacttcccagaaggggtggccgggcagaggcgccccccacctcccggacggggcggctggctgggcgggggctgccccccacctcccggacggggcggctgccaggcggagatgctcctcacttcccagacggggcagctgccgggcagagacgctcctcacttcccagacggggcggctgctgggcagaggggctcctcacttctcagacggggcggccgggcagagacgctcctcacctcccagacggggcggcggggcagaggcgctccccacatctcagacgatggcggctgggcagagacgctcctcacttcctagacgggatggcggccgggaagaggcgctcctcacttcccagactgggcggccgggcagaggggctccccacatcccagacgatgggcggccaggcagagacgctcctcacttcctagatgggatggcggccgggaagaggctcctcatttcccagactgggcggccgggcagaggggctcctcgcatcccagacaatgggcggccaggcagagacgctcctcacttcccagacagggtggaggccgggcagaggctgcaatctcagcactttgggaggccaaggcaggcggctgagaggtggaggttgtagcgagccgagatcacgccactgcactccagcctgggcaacattgagcactgagtgaacgagactccgtctgcaatcccagcacctcgggaggccgaggctggcagatcactcgcggttaggagctggagaccagcccggccaacacagcgaaaccccgtctccaccaaaaaaatacgaaaaccagtcaggcgtggtggcgcgcgcctgcagtcgcaggcactgggcaggctgaggcaggagaatcaggcagggaggttgcagtgagccgagatggcggcagtacagtccagcttgggctgggcatcagagggagaccgtggaaagagagggagagggagaccatggaaagagagggagagggagaccgtggaaagagagggagagggagaccgtggaaagagagggggagggggaggtggagggagaggggaggggggagggggagagggggagagggagagggacttttattttatttttgagactgagtttcgctgttgttgcccaggctggagtacaatggtgcgatctcagctcaccgcaacctctgcctcccaggttcaagcaattctcctgcctcagcctcccgagtagctgggactacaggtgtgagccatcatgcccagctaatttttgtatttttagtagagagggtgtttctccatgttggtcaggctggtcttgaactcccgacctcaggtgatctgcccacctcagcctcccaaagtgctgggattacaggcgtgagccaccgcacctggcttaatttattttttgtagagatgaggtcttgctatattggtctcgaacgcctgggctcaagtgatcctcccacataggcctcttttttttttttttttttgagacagaatcttgctctgtcacctagactggagtgcagtggcatgatctcagctcactgcaacctccgtctcccgggttcaagcaattctcctgactcagcctcccaagtagctgggactacaagtgcccgccactacacctggctataatatttgtatttttagtagaaacagggtttcaccatgttggccaggctggtctcgaactcctgtcctcaggtgatctgccagccttggcctcccaaagtgctgggactacaggtgtgagccacagcacctggcttatctcggcctcttaaactgttaggattacacgagtgagccatggctcccagccacaattcaaattttggaaaaccaattatctgccctaattattacgctccagccaaactacccaattttttttttctttttgcattccttccccacaagttactctgtgtcaagtttctaatgttgagtttcatcatttcactgacaacaggcttctaaaacccaggaatacttaagatctattggtatttctttgggtcaaattggtagagctaaagtacattgaagtcattcaaatacattcaaactacacagattccttataaattactggtatcaagaaaggaaaagattcaagaagacattacagaattcatcatatgttatcagaattactgatgtagtctatcctagcatagagtagctttctcaacctattgcataaaaattaccagcaagaaagaatagtacaaaataaggtttatggctaagttggctctgtatcataattatccattctagcattcttagaaggatcctggctgggcccagtggctcacacctgtaatcccagcactttgggaggctgaggcaggtggatcgcttgagctccggagttcaagacaaggctgggcaacatggtgaaacccggtctctaccaaaaatacaaaaaaaaaaaatagcctgacatggtggcatgcgcctgtagtcccacctactcaagaggctgaggtggaaggatcacctgagcctgggaggcagaggttgcagtaagccgagatcatgccactgcactccagcctgggcaacagagtgggaccccacttcaaaaaaaaaaaaaaaaaaaaagaagaagaagaatcccacctgtgataaaggcaataactgcagtcacatttgaatggctcatttcttgactcattctgaactcccttaagtccagtgtctgttagttctttcaagctgagaaaaattgttgagtaagaggtatctgtattaacatcctttctttctgcacagatcacaatcaatgtccttactcctctcctcctgtagggcaagccatctctgatctcctgtaagatctgtcctgctgttggagtgaaccgtctggaagaggggaggggaatttggtaccggggttgagtcaagttactaagatcctttaccaacatttctgagcagacgggatgacaggctgctgaatcttcctgggaattttcttcagtgggcatccgagaagactctggggtcaaggttgggttaagcttttgggatgggtccatcagtggcctagtcacagctctaagctcctcttggatcgttgggtttctatgggtgattctggactctcaaaattctattttgaacactctatccttattctagtcactaataatccagcacagaatattcctgatgaaaagtccatcagggccgggcacgatggctcacacctgtaatcccagcactttaggaggccgaggcgggcagatcacttgaggtcaggagttcgtgagcagcctggccaacatggtaaaactctgtctctactaaaaatacaaaaatcaggtggcacacggtggctcatgcctgtaatcccagaactttggggggccgatgtgggcggattaactgaggtcagaagtttcagaccagcctggccaacatggtgaaactccgtctctactaaaaatacaaaaattagccaggagtggcggcaggcgcctgtaatcccagctacttgggaggctgaggcacgagaatcacttgaaccagagaggcggaggttgcagtgagccaagattgagccactgcactccagcctgggtgacagaagtgtgatcctatctcaaaataaaagaaaaaaaagaattaactgtataacagtaaattaacttgaaaagtcattctggccattgtgtaggaaaaaaactaagaagggccgggtgcggtggctcacacctgtaatcccagcactttggtaggctgaggtgggcagatcacgagatcaggagttcaagaccatcctggccaatatggtgaaaccccatctctactaaaaatacaaccgggtgcggtggcacttgcctgtagtcccagctactcaggaggctgaggcagaagaatcgcttgaacccgggaggtggaggttgcagtaagccaagatcatgccactgcactccagcctgggtgacagagcgagactccatctcgaaaacaacaacaacaaaaactaaaaaggttaaaagcttaggtaagatacaagaacagttaaaaatgaaaaaaaaaaaatctgattatatctagtgctggcaaagcacctggagttttcatttcagtactgcatgtgagtgtaaaccaatccatcgttttggaagactgctgcaacgtctactaaaactgatcaaacacatctcctattacccagaattccattcctaggtatacactaaacaaaatgtgtacacatgttccccaaaggacattttaaaaattcctaggctgggcatgggctcacacctgtaatcccaggactttgggaggccaaggcaggcggatcacctgaggtccggagctcgagacaagcctggccaacatagtgaaaccccctctctactaagaaaataatggctgggtgcggtggctcatgcctgtaaacccagcacttcgggaggccgaggtgggtggatcacgaggtcaggagttcaagaccagcctggccacgatggtgaaaccctatctctactaaaaatacaaaaatttgctgggtgcagtggcaggcacctgtaatcccagctacttgggaggctgaggcaggaaaatcgctcgaacctgggagctggaggctgcagtgagctgagatgacaccattgcactccagcctggataacaagagcaagactgcatctcaaaaaaaaaaaaaaaaaaagaatggatcaattgtagcacattcacataatagaatatcataccatatcattgaaaaactcagctacacacacacacacacacacacacacacacacacgcgaatgaaactcacagtatcaagtaagctggatacaaaagaacatatactgcttaactccatctatatagttacaaaatagacaaactaatctgtggtcatataaatcagtgagtggttatcttggggaagagtggaggttagagactaggacagagcatgaggcttgcagggtaatggcaatggtcatatttcctggatctggctaccattcacatgagtgtgttcactttatgaaaattcaggccggggtggtggctcacgcctgtaatcccagtactttgggaggctgaggcaggtggattgcctgagcaacaaggtgaaaccccatctctactaaaatacaaaaaaattagctgggtgtggcagcgtgcacctgtagtcccagctacttgggaggctgaggcaggagaactgctggaacccgggaggtgaaggttgcagtgagccgagatagcaccactgcactccagtctgggcaacagagtgagactctgtctcaaaaaaaaaaaaaaaaagcaaagaaaattcagagctgtacacatatgacgtatacttttctgtgtaatattttaatttttcaagtatatatatggtagaggccagatgggaagatactgcagtagtctggatgaaggaagatattgggttttttttgttttgtttttgagacagagtctcgctctgttgcctaggctgcagtgaagtggcatgatctcggttcactgcaacttccacctcctcagttcaagcgattctcctgcctcagcctcccgagtagctgggattacaggtgtgcaccaccagtcttggctaatttttgtatttttagtagagatggggtttcaccatgacggccaggctggtcttgaactcctgacctcaagagatctgcctgccttggcctcccaaaggcgtgagccaccatgcctggttagatgttggtttagactagggtaagaagaaccataaagtgatccatttatgttttttgttcgtttccaattttccattttgtaaccactttagtaaatataatacaatcatcagcaaatctaatgtcaaaacgaagcattttcttgaaagagtaaatttcagtaagcctatatatagctgcgaatgaatgtaggtaacttccaggtatattaaaaattaaaactttcgtatttgacagcacaaatagaatcccggtactaatttaagacctaaccagattaggaatacaaaatatacggccaggtgccgtggctcacacctgtaatcctaacactttgaaagaggctgaggtgggtggatcacttgaggtcaggagttcaagaccagcctggccaatatggtgaaaccctatctctactaaaaatacaaaaattagccaggcgtggtgtcaggtgcctgtaatcccagctacttgggaggctgaggcaggagaatcgcttgaacccaggaggcggaggctgcagtgagccgagatcgcataccactgcagtccagcctgggcaacaaagggagactgtgtctaaaaaacaaacaaacaaatagaaacaatatataagccactcaagaaacatttatccttcatgatacaagggcaaactggccaggcatggtggcttacacctgtatttccaacactttgggaggctgagacacgaggactgcttgagcccaggagttcaagactagcctgggcaacatattgagactctgtctctacaaaaaataaataaaagctgggcacgatggtgcacatttgtagtcccagctacttgggaggctgcactgggaggattgcttgggcccagaatatcaaggcagtaatgagccataatcacaccactgcactccagccccccaaaaagggcaaaccaaattctaaataacatactactttaattgtgccttcacatggggaacatcaaacagtcaaatgtcaacactcaaattgcctactgttttcctaggattgctacaagtcttttataatttgtcttattctcacttaaacaattaagaaacttctttctaatccaactagtttatcagcaaatatgctgaagcacaagctgacttcagatgtctgtgctatatatatatatattttttccacttcaagaatctcaactgtgtcacttcccatggctagttccatttttgtctgttatactcagatgttgcctgtccagaaacccagttctgctgtgctagcagcccctcttcctaaaacatggcccaggatcacccacattcttggagtgatatgcagaagtagttatggttcctacctggcacacacccagcacattcccattaggagtgcatcctaatcatctttgttcttgttgttttgagacagggtctcgctctgtcgtccaggctggagtgcagtggcacaaccagggctcactgcagccttgaaatcctgagctcaaacaatcttcccacctcagcctcccaagtagatgggacccacaggggcatgccaccatgcctgggttttttttgttttgtttttgagacagggtctcactacattgtccagactggccttgaactcctggcctcaagcaatcctcccacctcagtttcccaaagtgctggattacaagtgtgagccactgtggccagccctgaccactgctgaaagatgcttggcaaactacattgcatagcagtaatggataacattaactacaaaaaaacctagattttaaaaaatctgtacttttgaaaaaaagaaaaacacctagtttttgtgaaaaatgtgtaaccatggctagtagttttaatctcccaagccaggaagaaaaaagaaatctaggccaattaatttaattttaattacttttttatttatttttgagagggagtctcgctttgttacccaggctggagtgcagtggtgtgatctcagctcattgaaacctccaactccaaggttcaggcaattctcctgcctcagcctctagagtagctgggactgcaggtatgtgccaccatgtccagctaatttttgtatttttagtagagacagggtttcgccattttggccaggctggtcttgaactcctggactcaagtgatctgcttgccttggcctcccaaagtgctgggattacaggcatgagccaccacactcagccaattttttttttttttttttttttttttttttgagacggagtctcgccctgttgcccaggctggagtgcagtgacacaatctcagctcactgcaaactccacctcccagattcaagcaattcttccatctgtctcccgagtagctgggattacaggcatacaccatcatgcctggctagttttttgtattttcagtagagacggggtttcaccatgttggccaggctggtctcgaactcctgacctcaggtgatccacccacctcggcctcccaaagtgctggaattacaggtgtgagccaccacgctcggccccgatttatttatttattttttgagacagagtctcgctctgttgctcaggctgaagtacagtggcacaatctcagctcactgcaacctctgcctctcaggttcaagcaattgtcgtgcctcagcctcccgagtagctgggactacaggcatgcaccactatgctcagctaatttttgtatcttcagtagagatgcggttgtgccatgttggccaggcaggtatcgaactcctggcttcaagtgatccacctgcctcggcctccgtaagtgctgggatttcaggcgtgagccaccggcgccccgccaggccaattaattttatttcagactaccttcacccacaactgcagagtctcagaatctaccttttcacaagcaccccaccaattctgatcaagttctactcaaatagaacacgaggtaatgttctggtttcaagagggagactaaataaaatacatgtttactttcatttcctcttatcatattaatgtatttaacatttactgaacacctaccacatgccaagaactgttacaagtactagaatttgtgtagttaacaaaccaagtccctgccttcggggagcttcaaccaaggaatgaagttatccatttttaaaaaataaaatatatccctgggtataagaaatgtggattttaaaggacatcctaatccctgtcattttactgaaaatgctcaaaggcaactattgtaaaacaggaccatttgcccaacattctaatacacaagtagaacccatattgctaaataaaaacataccttaaaggaaattgaaaacaaactatcagggccatctatcagcaaacatgttggtaatatttcattttcaataggctggtaagtctcctggtaagtcttctagtcttgataaagtgtacacagtcttaaaccaggaacatattacatatcaacaccccacccgattatccattcatggcttactacacctgcccagaattgtctagtctcaggttaatgtgctcctgaatcaaggacttatccctccttcatcatccttcgtcactttttccccaatctgaacccttattaaacaaagtatgagttatgccatctgctaaaatataacctagccagagaaaattaaaaatgtttttcaagtttagtcctcttcaaaaagtagcaagctaagatgattaaatgtgtagtctcattttttaaaaagctgttaagacttacacattagctttatttttgtgagcaaaagcaatcgtacaaacccaatatggaacaactcaattcttaacttgtaaccagtaaagtgaactgaatgtgaaaacctgaaatttatacaataattctcagaacatgcacagttgcatatggctacgtatttcatgctttattttgtctagatggtttcagacttctctttgctggtataccaaaacgtaaggaagaaagataaaggaccaggaaaaaaaattacacttgggcaagttatggtatctgctgattttatacagcaaaatctggtttaccttaacaatgctgtaattctatagcaccatgacaaccaggctttttgcaaaactcttgtcagttcccaagaaggaaggaaagtgaaaagaggagacccacgggcaagctaagcctcgctggaagatcaacaactggacagctcactcctgagattcctttccagcatacagtcgccctggctttcctcaaacgctatccaaaagcacttcagtttgattcatgtttgcaaactttccaagctgactccaagacgttattagatgtggatcactcccagaggaacatctcagagaaacaatggttagtgaattctttaaagtgcaataaattggaacagacaaaattcggcatatgtattttgagttggaaagttaaggaaataatttattgaacatacttcttttgtccgctgttactctgatattcttgtttaaaaaccaagccatcaaagttatgtagatcatgtctctctcttcccccaaacaaaagcttaattctttttttttttttttttttgagacagagtctcgctctgttgcccaggctggaatgcagtggcatgatctcagctcactgcaagctccgcctcccggttcaagggattctcctgcttcagcctcccgagtagctgggactacaggcgcctgccaccacgcctggctaattttttgtatttttagtagagatggggttttaccgtgttaggcaggatggtctcgatctcctgaccttgtgatccgcccgccttggcctctcaaagtgctgggattacaggcgtgagccaccacgcccggccacaaaagcttaattctattaaaaagtcaattgctatcagtgccttttatcccccttaaaataaaaacaacaaattatatagatttcatctacccctatttcccagatataaattaaatttcttccacatttaggcaattccaaaactaaaagtcatctttgcccataaaagaaatatttgcacaaagtagcttatgaattatagtacctggcctttctacactatctttcaaaataaaatcagtaagtagaaaataggagcccaggtttcatactaatattgcatttaaatttttttttattgtattttagagacagagattcacactctgtcagccaggctggagtggcacaatcatggctcactgtagcttcaaactcttgggctcaagtgattctcccatctcaacctcccaaagtgctggggtcacgggcgtgagtcacaccatgcccagctggaacaataaaatgtttaagttggctgggcaaggtggctcacgcctgtaatccccgcactatgggaggccgaggcgggtggatcacctgaggtcaggagtttaagaccagcctggccaagatggtgaaaccccgtttctactaaaaataccaaaaattagccaggcgtagtggcgggtgcctgtaatcccagctactcaggaggctgagacagaagaatcgcttgaacccgggaggcggaggttgcagtgagctgagattgtgccattgcactccagcctggggaacaagagcgaaactctgtctcaaaaaaaaaaaaaaaagtttaagttatattcacataatttccttgtttgaaaatggaattgatggcaatctaatttacagcaacctatttaaacataattactagaatattttaatttttcagacagagtcttgctctgctgcccaggctggattgtagtgacacaatctcagcacactgcaaactccacctcccagcttcaagtgattctcctgccttagcctcctgagtaactgggatcacagacacacgccaccacatctggctaatttgtgtatttttagtagagatggggttttgccatgttggccaggctggtatcgaactcccggcctcaagtgatctgcccaccccagcctcccaaagtgctgggattacaggtgtgagccactgtgcctggccaattacgagaatatttaattactaaacatagtagaatacacatttaagcaaaaccctcatttggaccacttaagagtgaaggcttacaaaaactagtaaaagtctaaaggaaataggttttgcatctttccaatacgtaataaaattgcaaagtcaatgtttataatgtattaagtagaagctcaaatgcttttaatagggaaaatttaatttggacatactagtaaagtatctaaaacatttattaaattatttttgtcaagtatcatctttactcatagatactaccaaagagcaacctagacagtaaaattagttcccgtatctgaggactccaaattaataaattttaatatattaatattaaacagagcatgcatttttagaaggatgcaaatttctactccttcatatccagagattaaattcagcaaagctaatggacttgttaacacttacacagaacatggaaataggtcctgactacatacatactccacataactactgaaaacttaaaacccagttgcttatttcatggcaacctggtagaataattatgtaataaacgacaataagaaaaagccacttatcatatagtctagtctttattgaaagacttacttcaactgttgtttacagctttggcttaagttggccattttagcctctcactgccagcagacataaaaatcaagtgggaatggcacgggggttgggagtgaaaatactagtagagaaattatgagaacaaagaatatggcagtcagtcagaaacacatcaccaaaataaatctcaaaataattatgaaataaaaaacatttccttgcatgcccaaaaagtctctgctgatgtttttgatgaacggggtggggagcaacgattcttaggcttaagttggatcaagatagcattgggtcatgttataaaatcatctgttagctcaacagccatacttttaattaattcatttattttttgagatggagtctcgctctgtcgcccaggctggagtgcagtggcgcattttcagctcactgcaacctccacctcccaggttcaattctcctgcctcagcctcccaagtcactgggactaccagcgcccaccagcacgcccagctaatttttttgttatttttagtagagatggggtttcaccatgttggctgggctggtctcaaactcctgaccttaggtgatccactacccgcctcagcttcccaaagtgctgggattacaggtgtgaaccaccatgcccggcaacagttgcactttttttttttttgagacggagtcttgctctatttcccagggtggagtgcaatagcacaatcttggctcagggcaacctccgcctcctgggttcaagagattctcctgcctcagcctcctgagtagttgagactacaggcacgggccaccacgcttaattttgtatttttagtggagacagggtttcatcatgttggtcaggctgagccactgcgcccggcccagttgtagtttttaaatggtacatttcatttggataagtagctttgtattttaaaaaccacttaatggccaggtgcagtggctcacgcctgtaatcccagcaccttgggaggccgaggtgggtggatcacgaggtcaggagattgagaccatcctggccaacatggtgaaaccctgtctctactaaaaatacaaaaatttactagacatggtggcatgcatctgtagtccagctactcgggaggctgaggcaggagaatagcttgaacccaggaggcggaggttgcggtgagccgagattgcaccactgcactccagcctggcgacagggcaagactccgtctcaaaaaaaaaaaaaaaaaaaagccagacaccgtggctcacgcttgtagtcccagcactttgggagactgaggcgggcggatcacgaggtgaggagatcgagaccatcctggccaacatggtgaaacccccatctctactaaaaacacaaaaaaattagctgggcatggtggcacgtgactgtaatcccagctactcaggaggctgaggcaggagaatcgcttgaatctgggaagcagaggttgcggtgagccaagttctcatcactacatgtactccagcctggcgacagagcaagactccatctaaaaaaaaaaaaaaaaaaaaaccacttaatatgaaataacttccattaactgatcatgaaattttgccctctttcagattaagatgaaggacacttcagtcacatgtttactgtggcaatataactagtctggataattttattaaatcatagaatatacagtcaggaaacactacagctatatttagctgttagttatctcaataagctacttaatttactggcagaccaaaacaggcatactaagcatttttatcaattaaaaaaagtcttcagttgttcaagtttcacatatactcataaaatttttaactcgggggcacagttaacataatttattgagtgttctccctataaaatataaattaacttttccaaaaacattcctcaaagatactataaacaaaagaaataagggtatattttataacagaagagtgtaatagatgaccattatggtaaaactaaggtgccataaaaaatttggcccagctatgaatttcagaccctatgaatttttatgttgaatacatttggctatattgctaagtgggaaaaggaggaaagtaataccaaaattattgtgaccaccaatttataaaatcattattttaaagctaatcgtaaaacttcaaatgtttagaaaacagtaatttgtgggtactaatcgcatcttactatgtaactgtaaaaggctattttctctttggtgcccaggccagcattttgaatacattgccaaaacatttgcactccctagctctgacaattcaaatacataggattttatctattttacattcctgtttgatagaaatttgaggcaaattttacccacacagcctgaaaaataccttgaaagcaaacctcggtcttctgcatcttccaattgattcctttacaaactctgcacacatacaacttaagcctctgctcaggcttattataccatgcacactgcccacaaggaaaaaaattaattgaaaataaaagccacaactctgtgtactatttaaactgaatatccaattataaattggtacattgaagtgtctaaataagatgtttttagcaatcttgttaaaaaaattcttgggcaaaatatatcttaatttttaaaaacaccccaagatttttaaaaaacacttgtactatacaacttatagtaaccttgaaattggtttacaaggttttaatcaaggtatttacataccaagtaatgtaaagcaaaaaaaaaaaaaaaaaaaaacaaaaacaaaaaactaattcccaatgacattttagaacatactaatgcatcaaagattgtatgaaattaaaattaaggctttttctgcacaatttgtgtaattttaattttacatagtagccaaccttggaaatgtcagtcttaacattctgatcaatccactgcattcaatgcagcggagtgtgttaagtgttacttcaaataattacattgctgctacttctatgttgaagcatgctttttaaacactgtagttattgaatatttacaatatgtatcatttaaacttcatgtaaaagcacaagtatgactgtctgacttcaatacaaacaccatacttggatttccccccaaaatgaaatgtaaaatactacaattttaataatcgacacttttggaagttttaaaaatatgtcttaacgtggaccaccaacatttgctcaagtaactcaaacaatgctgttccttttttagggtgcaaaacttcagtctggcttcagtttctttaggcatagagaaagaaaatatttcctccaaagcgactccaaaatcacgcatttcttctgaatatcacactttttctctgctgacttcaaatgtggtccacctcagggaaggggaggggagtatcaggattcaggatgaacttatatgtgattcccaggttttcacgatcctcccttttttgctcttttaaaaacacagtgagttaaaatactgaacagcaagataaaaatggaatagtatctaagaatcaaaatgtattagccatttttcctattatatcaaaatttgtagtcagaattgtctttattgactttattttagtttttgtacataaagaaaaatcatgttcatatccatcatgaacaaaaacttaaaaaggcagaactagaagacacgtgtccttcaccaaagcaaatctgtgctaaaggttccaaacatttcaatttttaaaataaatattttcattttccgatgtctactttcatgtcttcagagtgtcacaggaaatcgaagcctatcatgaattacaatttttttttagagtcccggctcactgtgtttggtaacttgccataccatatccggcttggttaggaggaggtattacagggggaggagcttgtccttggggaggctgagcaccaaatccacccatccaagcagcagaaggtgattgacttggaagaaaaagaaaaaatcttcagcaaacacaagaaaaaaaaaatcacatatgtatttacacaaaaatcaagcagagcctaatcacagaatagaaaaccagaaatcaacacacctacaacaaatagaaagatcaaagaaataaatgatatatgtgtagaatacatattccagtattagtctttgatatttttaagataaccacaacttaacacactgatgtctgaggagtatctgcaaactaattttttaaaaattgtgaatgattcaacacatcatctattacataagaaattttaaaaacaagttcatgttggaaacagtctcaaaggaagaaatctgaaaataaagctatgggctggccctgggcaggggaattacaaaggaggaaaccactctatcaacaaaagaaaaaaaaaaaaaaaaaaggccagttactttgtatcacacaaacctcagatttctcacacataccacataggcataaaaccatcaaacttttgaatatatctggacaaagatcttttacatgcaaaaataaataaaagtgtatcagaaatgtaaatcaaattctaccaactgcttacagggatcataggacacactaaatgttaccccaatcccccctttccacctaggtaatgagaagtaatttcttagcctcataaatcatattttgttagattagtttctataatgctcataatgccaaatagctcaatgtatataattaaaatagattctccctaggaaaacacacttttatttattttgtcagaaccatacgtttctatactggaaaaacccaaacaacttactctactccaaatccttgttgattccatggttgcccgtatactccataaggcggtacttgccacccatttgccatatactgtccatactgttgtgggtttccatacacttggctccattggccccattgactatagtcaacctaggaaaaagcaaagtattgttttagggaacacataagaaacaccgtatatgaagaaagagtgggagacaaggaagagaaaaactaagtaagcacccttatgtgaataggactctgttatttatcattgtctaagtttattggggtggtgacacctgtgaaaagaaagtattaagattcagttaataccgcaaataatcaattttgaaatacaatcaactgaaagtagctatatgctttattttattgttcattttacagagtttccaaagcttttatgtgacatgtaagatggaaaccttaaagaatgctatgaaaaatcgaattacctgttggaagtttttagtcatatcaggagattctttaccccaatagcatttaaccacatgtccttcaatcgtagtaccgttcaccgaaacaatggcatgggctgcactttcatgggttgaaaatctaagaaagaaaaatgatatggttttgtcttttattttttaagaacctaacacaataaataacatggaaactcatcagtttacacctgcaagttggtattttttttctaaagtacattaggtaggtagcttaaacttctatactgcaaagaagcactaaaataacaaacactgataccctggagaacataagtgaaaggaatgaatcaaatataagagtaataatgatatttcaagtagagtgttacctgacaaatgaatagcccttttctgggaaaactcttatttccataatttgtccaaatggtgagaatgtctgtctcataagctgatctataaaacaaaacatacaaataaaacatggctgatgtgtatcatgaaattcatatgaacagtgatgaagctcctcagaggtgattagaaaaccaaacattgtacctgttaacccagacgcaattcctccacagtacacagtacaattttttggacttgactggtttactacatcttcaaatctcaactgcttagtgttgtctgtatgcagaaacaaaacaaaaacgttgactgttatattgtactatgaaactcttctgttaattactatatactattaagatatgcctcaggccgggcacccagcactttgggaggctgaggtgggcagatcacctgaggtcaggagttcgagaccagcctggccaacatgacgaaatcctgtctctactaaaaatacaaaaattaaggcagggcacggtggctcacgcctgtaatcccagcactttgggaggctgaggcaggtggatcacgaggtcacgagttcgagaccagcctgaccaacacggtgaaaccctgtctctactaaaaatacaaaaattggctgggtgtggtggcacacgcctgtaattccagccactcaggaggctgaggcaggagaatcgcttgaacctgcgaggcggaggttgcagtgaactgagatcgcaccactgtactccagcctgggtgacagagcgagactccacctcaaaaaaaaaaaaaaaaaaaaaaaaaagatatgcctcaatgggaggagaaaacataatttttcttgatgctatgatttgacacagacttgatctataaaatcaggtgattcacagctccaaaaatacttataccacagcccaattattttcagataatgaaatataaaatgaaataattagagtcttgcaacactaattaaatactacgtcagcctggacaacgtaaccagaccctgtctctataaaaaaattacaaattagctgggcatggtggcatgtccctgtagtctcagttactcaggaggctgaggtgaaaggatcacttatacccaggagtttcaggctacagtgagctaagatcatgccaccgcactccagcctgggcaacagagcaagaccctgtctcttacataaataaattagaaattgagactagatgaatacatgatacatgattttgtgaagaatataattttaacacacacagtggacatatcttactttcttgtgtacttttaggtgcaggtggtttacgagtggcccaattggttcggatttgacgaccacccaaccactgaccgcccatatgcacaatcgcattttctgcatcctatggataaaaaagaaagcacaatcacaaagaaaagagtgataaataagactctgtaagatgaaataaaatatcggcgctgctggttccatacaaatcagtagatgaatttactaaatatcctaaacaaaacgaaactgaactattaccaattagaaaacgatttgaacttgagattcaatctaagcaaaaacagaatactctggccctttatcttaccacttcaataaaatgtagatgacctgtaatcccagcactttgggaggccaaggcaggaggatcacttgagatcagaagtttgagactagcctggcgaacccaagtgaaaccatgtctctaccaaaaatataaaaatgagctgggtgtggtggcacatgcttgtaatcccagctactcaggaggctgaggcagcgcgatcgcttgaacccgggaggtggaggttgcagtgggctgagatggcaccactggactccagcctgggcaacagagcgagactctatctcaaaaaaacaaaacaaaacaaaacaaaacattgatttaagttattgaaactgctttaaaatcaaagcccactttattatttaatgttacagttaatgcaaatgcttactttggtaccccttttacaaagaatatatgcaaaaatcaagatgaattgcttaaatttttatttacataatttgttgtagtcattcacatcccagttatataagagtatgaataataatttaaaaggtagagttaaaactgagattttcatggttaaaactgaatataatttacctaacctctaaattctcagattagctcatctgtcctagacttgggctttacttctaaatccatctgacctttaccaatgtacaaacacaattttaataatcttccttatagtataatcattctttttctagctatttattttcgagtttatgaaagaggaatgaaattatactctattattaaaacatacataacattacataaaagttgtgtttgtagttaacattcaagtatattcaagtttcagattcaatacattaagtaactaatgactaaatttagtattaaaaaatataaattgagatggaagaacgtaccagtttgttataaaaagatacaaaaccatagcctttggattttccagttgccatgtctttaactacccgggcatccctgtgaaaagaagcacagctaaatgagggaagtaagagccaccctcaaaataaaaactaaaaggaaccacacacactgtattgtgagcatttttaaaataaaattccagttagccctaattaactacaaccattcctgaactctccctaatgcttctttacctgttagaaaaaagcagtaggacaaaaacatgtaataaacatgcaacctaatcaaatagcctgtgctttctaaactaaatgctcaaatttgaagattaataggaacaacagtttccctttctaatattctatttactagtgtcctctaaggtttactgattctataaattactgtaacaatactaactactttaccatgcaatctctaaatagttaaatgtcttctgcctagtgatacaaaatatatgaaatattaaaaaattgaaaaagaggaaaaaataggaattaaaaaggcatacatggcctgttaacagatttctttatttttcttggtcaattctctaccatcattttggagtttgggcagctgtaaattttgaaaaattgacattttcagaaatttaagaaaggagaataaaaaactaacaacaatgctaagcacaccagtacgaaaacaacaaatttacacagaaattttagtgagtaagttaaatgattggaaatatagaactccactgaatatagaatgttaaaatgtaaatactaaaatatgtatatataaataatgtataataagaataaatagaaatgagaaaaaaaatctacaactgagttccagtgtgcacagttccttgcagttagccttcaagatcctgtccattcttatgagcaattctgcaaaataaccagaatgctattacttttaattgtgacttggacttaagaaaaactgcaggtctcaggtataaataaagattgaaaaacagcaacctgtattatttttatattgatttttaaaatagtactacttaccacatttagattaaaaagcaaagcaaatatcaaaacagaaagttaagaattacatcttttaaagaaattaaatctatagaacaacaaattgtatagagaaaatattgttgttcttagttgaaacactttcctgtaaagtagtactaagatgtttaatttaaatctacaggaaatatacaaaataaactgattttaatcagaaagataaattatgataaacattttctacaattcataaccatttttagttttccaatatattttttaccaagtaacaacagtaaaatctgagcataaatttgttaaaaatcaaaccacatttgcctcttaactagtagaatcaaatatcactaacaaaaacatctaattaatcccacatttatgactcatacattgaaacattttaatagtataatagtacttttcacttatagctaaaatatcaaaaacacatttatcataataaaacatgaacatttccaatttaatcacaatatatccaaggatttacctactctcccccatttataaattcctcctataaaagttattgaactcttacacagtatagatcacatttacttttgattaactcattatcctaaaccatcaaattttgaaaacatatgacaaaaagctagactttataagttttaccattcaaacatctgcttcaaagataacaaacagaatcacttaaattttttttaacatattatacacaggattagatgaaaacgagaccccaagacactgaaatgacattaacattttcaacaacatccactactcaaaacaaaccaaaataaataaatgaaaaataagaaacaaaacaaaaccatactaactagagaaagaaaatcttaattcaattacaagttaatcatatacaattctgcctatcatgactgagtgtagtactgattatgatacttacgatattttaccaaagggggcaaatgctgatttgatatcttctgttgtaatttctggactcaaatccccaacaaacacatggaagtgatctgaaatcagagcatttggtaatcaaatacttaagaagtcagccactaaaacctttttaaggcaactctagaggaggaaaaaaaaacctatttaagctggtaatgcctcctggataatttcagaactcttccacagtaaaatgcagcaggagtacttactggaagtatcttttttctggctacttggtgtggttgcccagtttactttgacctcctaaaaataaagattatatttaataaaattattaggcatgtcatgagttacaacacttaccacttattaaatcatttatcaagcagggttatttttgtaaaagcactaagctgaataaagcaaaaccatcactcagcagccgaatatctgctcaaaaatttgcctagaaagaatacaaactagtttgacatgcaaatatatgtactcataaggtgccatcatcctattatcttacctttcccaaaatttttctcccattcatagcagctaatgcagcagctgcatctctgtgttcataaaattccacaaagcaatatgggtcattgcttgtatgctgcaaaacagaaaatccaacagaagagttgacccttctgctatcgggttgctgagaagaaaatccaggaaaaaacattactgatagctgggaatatacaaggtgagactgcataagcttatgaaagcctaacactttttaaataagatttaaagctaaacctgactttgcacctcagaatactgctgaactcaaacggaactataaaagcagttgtagaatcatgagcatcagtattaaatgaaaataaagaattctggtgaagtgtgttaaatataaaatagaagattatattaaaccaaacaaaacctcaaactcagatctgatgaggaccactccttaccactactttccttctccaatattatttttaaattacgttctacttatgcatcataatcctctataagtggtatcccaggatacagaaatacagcaagaaccaacttcataaactactgatcaaaattaggatcaatactacaaatgatggaattctatgctgctacaaagactgaattttattgatttcttttctggatatggaaagaatgaaaataaaaacaagaaaacttaagctttataaccagctactgaaatgaattccctaccttccaaaatagtctaatgtactgaagattctatatactttgaatttggtcttccaaagatcagagaaataacagtggtgatcaagaaaagaggttctgaaaatgtatctgaataaaatattccaagacaaagctataagtttacatcataagaacaccatataaaaaatctatattaaatatattctgcaaccctgtgcttgacagtagttacctaaaacacatttataaagatgtgaagaaagtagtactacctaagctatagcaacattctcacctgacaaccaaactagaaatgaatttctatgaaactgcaacctgtactgaatagctgcacaactgtacaaatacatatttttatgtaaggctaaaaacattcatcattattcaatgtaaaatgccctataagaataatatttaaaatgtggaattctagttggacttacaagggataaatataccagataaaataaagatcttttcaaccacaacagtttttcattccaggaaagttttagaagaaaaatccaaaataagacgtctaaacaatagtggcaaaggaaccagaaggcatttccttgagggaaaaaaagtgggatcgttaatactgacaacaaaactatgggctctcatacaaaatcctactgttgtagccacgtgaatgctgttcttaagaggtaaagaaaggaaatgggggaagacttcaaatgaaaacacacatttaaattcttgtaaaagagttattacatttaccataaatattcattgaagaaaggacatcaaaataaataagaggctaaaattgtgctagttgagttttcctttcactcctatctcttttgccccaatggtctctaaggaaaacactgataatcacagcaaaacatacaggggtccaacagcagatctatgataatcccatacactttaggaaactagtctactcgtgaataccaatttcaaatctatctaatagtaggccagctcccaatcaatgtatgcacgtgcatgtatatatacacatatattcactgacatcacatattttatatattcacatcacactgcatatcatctaatttaagacaccacttatttctaagtcacatcccaactgtcagatattaaaattctaaaaaaatttgacttagaatcaataatatatatttgtattatataaggaaagctagaatctatgataacaacatctaaagtaaaaaaaaaatcataaaactatgggggaaaaaggatttttcacatactgaaatgaaatttatgaaagaaaaataaatagctgctagatactctgctagagtttataccctctggaagcttcttatttacaccaccaagtgacatcctaaaaatcaattatgggctgggtgcagtggctcacacctgtaatcccagcactttggaaggctgaggcagctggatcacttgaggtcaggagttcgagaccagcctgaccaacatggtgagacccccatctctaccaaaaatacaaaaaattagctgggtgtggtggcgggcgcctgtaatcccagctactcaggaggctgaggcaggagaatcgtttgaacctgggaggcagaggttgcagtgagccaagatcgtgccactgcactccagcccgggcaacagagccagactctgtctcaaaaaaaagtgctcacgcctgtaacccaagcactttgggagggcgaggtgggcggttcacgaggtcagaagatcaagaccatcctggctaatatggtgaaaccttgtctctattaaaaatacaaaaaataaaaaaataaaaaatattagctgggcatgatggcacgcacctgtagtcccagctacttgggaggctgaggcaggagaatcacttgaacccaggaggccaaggctgcagtgagccgagatcatgccattgcactccagcctgggcaaaagagcaagattccatctcaaaaaaaaaaaaaaaaaaaaaaaatcaattatggctgggtgcagtgtctcatgcctataatctcagcactttaggaggatgaggcagaggcaggaggatcacttgagcctaggagtttaggaccagccagaagttcgggaccattggtaacatggtgaaaccaatctctacaaacacatttaaaaatgaactaggtgtggcggtgctgtcccagctacttgggagactgaggtgggaggatcacttgaacccaggaggtggaggctgcagtgagccatgatggcgccactgcactccagcctggaggacagagtcagaccctgtctcttaaaaaaaaaaaaaaaaaatccgttatgtccctaccttatttagcgttgtcaccaatttttgttggatgacataaatgtcaagacagagaaatatgagactttacaagctcaaatctaggagttctagaatatggatgttatgaaaattcatttcgagtccctctacccttcaaatagctgtatgtatacatggggttttaaaaaatagttaaaataaatctttacaaatgtttctcaaaaattttctagtgagtctttccccactttctcacaacccgttctctcctaaacctacttctgtcagcttccaagctaaccatgccactgaaactgcatgttgagctcaacaatgacctctctgctgcttctgtgattccttttccatcctaatctttacttccaagcagaattcactacagttgaccaccatcctcctttaaacattctcttctgtctcctaccacactctggttttcctgtttcctcactgtaggatctttcttcccttactcaaactctaaatgttgagcttgtccagggctcagacctcacggcctctgtgctcttctttaccatcattctctctctgtgaactcatctagtcccatggcttcatggattcaaataccactgcaagcttcagcaccggtctctctagagttgcaaactactttatccaactgcctaatctaacgtccactttgatgtctaattcatgtcttaaatctaacatccaaaacacaatttctgattcccaccactccccatggtgacatccatcaggtcacccccactttagcaaataaatagcattaccaactatacaactgcattaacatgaatcttagggtatttcctgatttcttcctttccctatgtcccacagccaacccagtcctatcaattctacctccaaaatatattccaaatctatcaacctctgtccttatcttgacttcggctagcactttcgagaataagcctccatcatctcttacctagactagtgaagtaaatccagatggtttttctccttctgctcttgcccgctacaatctattctccataaaacagtcattctctacatagagtagtaagcttaaatatgcaaatcttggcacctcatccccctgcttaagcccctccactggtctgccacagcaatcagagtaaaacctaaactatgtcatggaccataatgtcctgtgattctgaatcctgctgttagactcatttcccttaactcccctccatccctcaccagactctagccatcggtctttgattccacaaacacaagttcattaccaactcaagacttgtatttgctgtttcctctgcctccagctcttaccatagatagcaccatcttgttattcatctcagctcaaagaggtgacatctctcatcacctagcctatatagcaccaaccctccaatcatcacagaactctgttttattctcttcatggcttacatccctatttgcttgggaaactcatttggctgtctctccattatatctccagtaccttgtatagtgcctagtgcaaaggaaatttttgatcgatgaaagcacaaataaataattaaaggcaggaaggaaaaatataatacaccagaacaaaatgatgattgtcattacttgggaaagacaatcaaaaggccaatgcactttaaaggtttttaacagttctccgtttcaggataaaacaaactctttagcacagtttctagccctttccataaactcctgccatctcttacgactaattccattttaactacaaccatgctacgggttctatttttccctctctgtctcaagcactcctgctctccctaccaacctggatcaaagttccctttatttggaatcccttcttccctcaattcctttctagccagtatgtactactatcctttcaaggtttccgcctaggcagtgagtcctccaagaagccgctcactgacctaaggctgcactggatacacatttgctcccacagcactttaagttgtctgcttctagagcatttattatcctacttcctaagtgcctgctaactcctttgtctccctactaaactgtaaaattctctgggccaaggaactatctttattcaccagtgtatctctagcacttactgcagtatctagtacataggaaatagtccaaaaaaaaaaaagaaagctgatcaatgaacaaaaacacaaggaagaaaagcctaaaacatgactaattgggtgctgctacagtcttagcaggaaagtataaaaaggtaagtatttgctacagacacacgagacgaacggtgctgcacactacacacataataacttcgtgttctcgcacatgaacacatgctgtctaaatcgttaacattcttattggaattgtatgaaatactttccaatttttcaccattctgaaatgagctctaataatgttctgaaagcagaatcacttcaagataaccacaccatgaagaatgaccgtttgagcttaacagcacggaaactttgccctcttaaataaaactccattctaagcctagtttgtcagccaaatcaaagtaataagtcaacacaacacaaatctctccaccagaataacttgaggcttacaatgaaattttaaaatcatgctaatcaacccatcatgctaattgtcagcacatggaactgggaagatcttacctctgttatcattttacagcttttacagggtccaatctgactgaacaactgaagtataaggacttctgtcacatctctggaaaggttacctacgtatctgcacaagaaaaaaatacgttatcagcaatttttcctttagctctggctctaatgtgttatcatctaattcatcaccttttctttctttctttctttctttcttttttttttagatggagttttgctcttgttgcccaggctggagtgcaatggcatgatctcagctcactgcaacttccgcctcccagattcaaacgattttcctgtctcagcctcccaagtagctgggattacaggcgcatgccaccatgcctggctaatttttgtattcttagtagagacagggtttcatcgtattggtcaggctggtcttgaactcctgacctcaggtgatctgtccgccttggcctcccaaagtgctggaattacaagcgtgagccactgcgcccggccaccttttatttcattttaacttcctctgttttcaacaaaatttctccaattaaacctgatcctatgaaagtaagattaacccttatttaggaaagcaacaattgttcttaggccactaaaataccactctgaaagacatttaaagaacaaatcaatgtgatcttgtataccccaatggcattattattctgtaccctggatatcattttctcatcttattctaattgttaaaattttaaactggtctcaagataactacaatttctaattaaaaataatttataacacacacacacatacaacaaatactaattcattaaaacatctgattgtaataggatattaaacataaagtgagtttatcttagattcccaaccaaagcaattacatgaacaaagaacagaattaaagttatagtaaaacatacagagggtggagggtttttgttgttttgtttttggctgagtaaggttgtttgcaatgatgtcttcactgtttcattttaggagagcagggtaaaatataaaatttcctagtctaaaatgcatcagaatcaacaaaatatatatgtatttttttgagatggagtctcactctgtcacccaggctggagtgcagtggcatgatctcagctcactgcaacctccgcctcccaggttcaagcgattctcctgcctcagcctcccaggtagctgggactacaggcgtgcaccaccacgcccggctaatttttgtatttttagtagagacggggtttcaccatgttggcctggctggtctcaaactcctaacctcaagtgatccacctgcctgagtctcccaaagtgctgggattacaggagtgagccaccatgcccagccaacaaaatatatcttaatgtagataaaaaagctaatacaaagatttcttaagaaattcagagaaaaactaagacaaatccaggcatacttttgactatggacacttaaaaatttgggttttttttcctaattacaattgaatgtgttttgtgtaaaagattttaaatacaggaaagtttaaaaaagaaaagaaaaaaatgctacttcatcacacagagaggaccaccttggtttatgtcttgtactatggatttatcttaatttatctaaataaattgccaaacactaaagtctttctggtattctacacataattcctcaaatttgcatctgttatgaacaacctcataaaccaaacaatatctgtaaaatttaacaaagttcattctggaaagtagatttctttttctacttgtaatatattacatctggaaactgagtattaagaccaaaataagacttgcaacatagctgccacattaaatacacaacatgctttaagatggaatactcaaagggaaaaatagactgagaaagcttaggttaagtaaaaaacttaaaagatccaattaagaattagtagcgattttccagttaagaattttattgcaatgagtactaataatcttagtgtacctgctctaaaattgaaacacacatccaatattacctaactagaggactaaacaagtgacaaactgttttacgtccactatgccaccttttccacgtaattaaggagctgatccatcagcaggccaatgtagtgacatactttttccagcaggactaaaaggttattgggttatgagccagcgataggctgcttgccccttcttaactcataggggtttgtgagcctgtatctctgaaatgatttctttttgtacagagtagacctatctgtaagaaaaatgaacaagtgaccaggcatggtggctcacgcctgtaatcccagcactttgggaggctatggcaggcggatcatgaggtcaggagtttgagaccagcctgaccaacatggtgaaaccctgtctccacaaaaaatacaaaaattagccgggcatggtggcgcgcacctataatcccagctactcgggaggccgaggcaggagaatcgcttgaacctgggaggcagaggttgcagtgagccgagattgcaccattgcactccaacctgggcgacagagtgagactccatctcaaaaaaataaataaaaaagaaagagagaaagagagagagacagagagaaagagagaaagaaagaaagaaagaaagaaagaaagaaagaaagaaagaaagaaagaaagaaagaaacgaacaagtgatcttgagcttctaaacattatgctccttgcctaaagggctagttagctcacttctaagagaaaagaaggatggataaaactggttttcacatattgaagctagctaataacaaaattaaaatagaattatcattttaatataacacattttaaatgatttaaatagttttaaatttccattactgtttaaacatcaatttcttcaggaaaaactgtattggaattagttaccttctatatctaatagtcacaaaaaaagccgtcactgcttaataagatctttattccaccaggtgtggtggctcacacctgtaatcctaacactctgggaagccgaggcaggtggatcacttgaggtcaggagttcaagaccagcctggccaacatggtgaaaccccgtctctactaaaaacacaaaaaattagccaggcatggtggcgggcacctgtaatcccagctacttgggggaggctgaggcaggagaatcacttgaacccgggaggtggaggttgcagtgggctgagatcgcgccatggcactccagcctgggcaacaagagcgaaactccatctgaaaaaaaaaaaaaaatctttattctaagtcaacctatttcccgccagttacagatcttgaagaatttctagaggcatatttagatatattaatttacatttctagcactgaaagcaaagatgaaaacgttaatatctaagtttagaatgtcatgaaatatttatttaaaaatccagtattaaggtttcctatttttcaaattatctccactaaaagttaaatgttaagcagcaaactaaatttcaaaaactaacatgaaaggccttccataacaacacatacaatatcttaatttaccaggattaaaaggccatgattcactatataatttcacctaaactttacccaaatttcagactgccttttcttttactgagttcttgtacccaaatttcagattgcctcttcatttacatttgccttcgtgcatcataacacttgagagacgtattgtatagcttttaaaatactgtactattctattttaagtacttttacagtatcataaaataatctgtcccaaagtaaatactaacaaaaatatttaagacaaagttcaatgcctgacctagtaagatcatctcttggtagttcattgaaatgacatctttattcgttccaaattatagcttctacacttcactttctttctgctctggttatgaaatagtcaagctaaagatccaagtctttaaatatataattgctacctaaagaacatacacaaaataacagaaaaaagataaatggctctaatttttgtattgagaggtcaattcaaagagtaaacacttaggaaattccaaaatgatttttaactcaacgaaaaaattcagaagaggcataccttagagtctattttgtcttctaagaacaggaactgtaggaactgaagcattaaaaactgaaaatgacacctttatctctaatatcagggttaaaatccaatttggggctaaaaacttagcagtttcacagtaggcagaaattcacattgccaaactacttcctgtgtccgactgggcagaattttaagttaagaatatcatgcctttcagaagactaatgacactttttcaacactgaatgtgctctcactctgaaaagagtagccctaccaaggctgaaattatcagcactttcacacaaaaaactatagctaaatttccataatagttttgcttttgttcttgacaagtcctatacaagaagagattttgcaataatatccttcaatagatctctaattaattgttcaatttgtcggtacagtatttcattttaggaaggaggcatgatggaagatagctgcaggaggtacaactaaattgaccaactatatatatgagatattctcacacacacacacacacacacacactcactctctctctcttactttaaagaaacaaagaatatgattaagttgaatttgaatgaggggcttgattatagccacagtatagccaaatccatggtatagccagtcaattttgtaatagtttatagaattttcttctgctttgttcttagatgttcagattatactctaaatcattagcttatttccaggaagaaagaatagccttaaaggaagggattgtgtaacatggtattacacgaattcctagcaattttggtgcatccgatagatgaagaaaataaaataagctacaataaaacactattacaatttagtgtcatattgtagattcagatataccatggatcaaatcactgcactacaaagatacacacaacccaagcctgaaatgtgtgtcccacaaggcaggtgtcagacagtccagttccaacaccagtattacacagcatgatcttgtttgtttttttagatcacaagttactcaatgcataataccccaaaataaatgtcaaatgagaatgaagaacatcagaaaacagacctttaaagcaactatatgacaaatagaaatttaggctcaacatcaaagcaattcttgccactttaaataccatcaaataaattagtaatactgtaggtaatgaatatttaaagacctacctaggctctaaacaccatattgttttctgaagatagaaccatatgtcttagcttgtgtgtgtctgcaggaaaaaaacctcactagtaacacacaggcatcttaaggaaacaatttaagataagctttgttaagaacacattcttttaaaacatactggccacttgaaaaacctaatccatagctcacaatgtaaaatataagatctccataaacaaaaaaccctactagatatcaacgtctaaaatcatgttcagttttcatcatgttacttatatctaatagaaccctttgagaatatgtaaaacgtacacttagaaaaactatgcattatttgtattaaactctaataaaaatcccaattgttaaacatttgcttttatctcaagattttacatttgaaggttttaaaaaatatataaaagtcaacagactgcaccacatgtgacagtaatgtctgcctacaatcttagttcaaccaggacttttaaaaaagaacttaatactaatttaatgaaagaagtataatcactgtagaaattctgagtacctcttatgttccaggcagtgaactaagtgctgtgggggtaagacctaggaagatgtagtagtccttctcttaaaaaaaaaaaaaggccctatggaaaagggtgggagaaggaaaaaggaagacagaatagtaaacacgtactgacatacaaaacaacagagttaagatgtttatttattcatatgaacatgtcacagttttagagaactgtaaacatagacaacttaactgtttcaaagaaagaacaagagattagagaaggtagaggaaggaaataagtgacaaagaagttagcttattattcccctggagaaactctgatagggatgaaggcaaggcagatgcaaagataaataaaagacatcaaaaaagcacattctttagcactacaaaaccagagattcctcttggtaaggaacagatacagtaaatgagacccctgccatgagtatttatcaatcattcagtgtgtgatgatacttcagatttttagatacaatgtaacttttatctttgttaaatacatgttagctagtctttaagcctagctttcccagatgcttatatcaaagtacacattgtaactcaacaccaagtcttggcttcaacagatgttgaaggataaaattttttttttaattgtttagacgaactctcgctctgtcaccagtctggagtgcagtggtgcaatctcggctcactgcaacctctgcctcctgggttcaagtgattctcctgcctcagcctcccaagtagcagggactacaggcgcgcgccaccacgcccagctaatttttgtgttttttgtagagacggagtttcaccgtgttggccaggaaggtctcgatctcttgacctcgtgatccgcccacctcggcctcccaaagtgctgggattacaggcgtgagccactgcgcccggcctgaaggacaaatttcaagtgtgtcccaattctttcttctagggagagaaggcagaaatggaagacaacacaaaacacaaagacgttctattaagcaggcgtttcattgaagcattggatgtgcttcagtaggcctcagattctcaaaacgggacggatacttcagtgagacgttagagaacacatttattcctgtacaaggccacaccaaaaaaatctctatcaatactgaacatctatcttctttactgagcatcctttctttggtaggagtgaagagatgtgaagctagtcaaacttctcgagtgcccctccaccttcatctattccctaaaaagcaatttccccatcagagagcagagccaagtggactatgatcctatcaataccaggagaggcaagagaaacaaagcagcgatctgactccttggtactcaaggtaggagtgctagacctggagaggccgggaaattagggtgcccaatttaaacatttaattaaaaagtattcagacttaaaaaaaaaaaaaaagatgcagagaaaaggagtgccacactattcagaaaggaatgcaaatgctgagtcatcactcttcattggaaaggaaggaaaccagaattaagtggttggaagatggaattcattcattagattgagcttcaggtaaaaagcaacagcaagacaggagaaaaagcgttcagaagacacacatcaaatagcggatgaagacataattttagccaactctgaagctttcgacgcacaaacagattaggaagaggcaacacctagagagcaaaaggagtttaacaactggttgtcagtttagcgtagggagcgctcaaagtaaacttctttatccaagaagggaaagatgctcgggcagcaaaaggtatcccttatgtacttcaaaagtagcgggcgctaggcgggtgtttctgacagcgtgggcgggggcacgtggggcataaagagagaaggggcttgagtggtgaaagagtgtcctgcttcctccgagagcttagctggggagaagagctgggagcgactcgagctgaggacgtggaaggggtgagtgctaattcctcagggcccgcggggcccacccccgggcccacccccaatcctacccccgccaggcccttcccccgtgggcgccggcagctccaggcccagcccagggcgtccaacgcggagggggtgcaggagttctcctgggcctgacagcctcagccgtgcagaaacccggcctagggagggcatgcaaagaaggacgccagagaaaaaggtcgagacaagccccagaccccaggaagtgactgtttgggggaagggaggatttccttcccaaggaaaaggggacagatgaggaatgcacttcgcgtccacgccgccctggtcagggagccgcctagagtcccggcttcggcccagtctctcctgctccctcccttagcgtcccgcggtgcccgggcctcttggcgcctggcacccctcgtctcgggtactcacagagtccggggctgcccgtcgtcttccatcatggtgggtgcgacggagcgatcccgggacaagggggagggcagggttggggaggggagggggtggggaggaaggggaggggggctctgggcaccggctggggacagaggaaaaggcaccgaaccctgctctcgggctctctccccccagcccgctccggacactgcgctccaaccaggaggagcaggaggaggaggaggatgaacaaaatggccgccgccaccagccaggcaggaaacagggcagagcgcaggcgcgacccgccaggtcaccgctcaggccagccgcgacagcctgcaagggggacgaccgaggggagagaaaaaagggccgccgaggaaaccctgggacccgctcacgacggatcacgtcgtcgctgtgggcctctggccggccgaagcccagccagctccgggagagatcgggcaaaaagagaaacgtcgtgaagccgaagtctctgggaattgtggtcctggaaatgagagagggaagcacttctgcagaggacttctggaacctgtggttaagaggagccgccggcgcccacccgcgctgggacgtgaagaggagacttctgggtagtgtagtcatacgtgaggacgtgcgacgaccaggaagtcggcgggctgggaggtaaagggaagaataaaagcgacattgaaaggcggggagaccaagtggggaaaagcgctgtctgggaaagcgaactacaagtcccagagttcctcgcgccgggggctgtcctcggactgctccaggcattgtaaggctcttctgttggcccagtctgagctgctgctccgccttcgtccagcccgagagcggtttcttcaactgtggctcaggcagcactctccctccgcgtggtgtccgagccagcagggccgtccggccctcctgtgttcatcagaacggctggctcgcgttagtcaaccgccgcttcgcgcgacagtcagaagagaggctgtgctggcggggacccggaggggttggggtgttttggggactcgatttcccacaaataggtatttctagcctatttgttaaatacaagtaggtggcctgcttgtaaattgctttacaagtttcagaggtttccctatcaaatgtctcatcggatagtggggtaagaagaggagccctattataatgacttgcccaactccccccgtattcttggagttaaaagaaaaaaaaatccttgggcagagacgtgcacaaacataaagttgcgtttacagacatcagtcatgtgggctagaaacgcagttttgcatgaagataggggaagccatgttcatactagctctgcatccctgtagaatttgtcttctcaccccccacaacagttcctggtgtgcttttttcctcctctaagtaccttcaggagaaagtacttggtcttgtagcttagtgaagagtggcgatgaagaaagatctttcagcccattgccagaacttaactgccccggttagtaatggcttaagagttgcttctgccgacatgtactaagtgcatgtcgacctctgcaagtggcggtgcgtatgcgtgccactgaacattaatcttgaaagcagaatcaaccatgcagcaagcccttatgttgtccattttcaggggaggaaatttcaacctgaaagacttcatagagacacggcaaaggagttgagccccataagagtccgtaggaacaacaaaaggctcagacgccaggacccatggctaaaatgtatgggctggggatgcgggcgggagcggggggaagggaactaaagctagagaggaccttgtagaaccgtgttgtcaagaatctatttcatgctgaggaatttgagctttctcttccaggcagtgaggagccactcaaaggttttgtctatgtttttaattggacctaggtgtagaactggatttaattataatccaattcattaacccatgcctggcccgctgtgatagtttcctgttgatgctgtaacaaattactgcaaatttagatacttaaaacaacacgaatttattttcttacaattctggaagtcagaagtccaaaatcagttacactgggctaaaatcaaggtgtcggcagggctggttccttgccttttccagcttctagaggctgcctgcattccttggctcttggccccatcctccatcttcaagaaaagaagcatagtatcttctttcttctctgcctctgtacgtacatcgtgattctcctgccaccccttttcatttacgagaaccttttgtgattactttgggcgaagattatctcaagattcttaatcacatctgcaaagtcccttttagcataacattcccaaattctgggaattaggacatagaaatctttggtggaccattattcagtttaccgcacccacctttattactttagttttgattatagccacaaacccaccacactaaaaagttataatgacacgagtttatatctgtatctatgctatacctcctacacacaataacacacacccctgccttcgcttggggtaaccatctttctgaatcctgtctttactatttattgctttccttctacaaggttttattccacatgtacatagtcctaaaaatcatatgtatatacatgtatatttgagtttttttttaacttagtaaaaagaatatgcccactacaaactagaatggttaaaatgggcatgtttactggcagtgaaattattaaggttaaaatccaaaacactaacaccaccaagtgctggtgagtatgaaaagcaacaggaactatcattctttgctggtaggactgcaaaatgttatagcccctttggaggacagcttgtcagttccttacaaaactaaacataatgcctaggtacttacccaaatgagctgaaaacatgtttacataaaaacctgcacacaaatgtttacagcagctttgttcataatcatcccaaattggaagcaactaagatgtccttgatataagtgaatggataaactgtcgtacaaggtggtacatccatgcaaagaaatattgttcagtgatttttttaaaaagagctattgatatggtttggctctgtatccccacccaatctgatcttgaattgtactcccataattcccacgtgttgtgggagggacctggtgggagataatttgaatcctgggggcagtttcccccagactgttcttgtggtagtgaataagtctcacgagatctgatggttttatcaggggtttccgcttttgcatcatcctcattttctcttgctgccaccatgattctgaggccttcccagccatgtggaactctaagtccaattaaacctctttttcttcccagtctggggtatgtctttatcagcagtgtgaaaacagactaatacagctctcaagctacaaaaagacatggaggaatgttaaatgtacagcaccaagagaagcccagtggaaaaggctgtaaacgctacaactttaactatatgacactctggaaagggcaaaactcagtggttccctgggcatcagggaaggagagagggatgaataggtggaacacaggtcatttttactggtagtgaaattattcagtatgatactctcatagtggatacatgaccttatgcatttgtcaaaacccatagaactgtgccacacaaagtgagtcctaatgtaaactatggacttcagttaatcataatgtatcaatagttgttcctcagttgtacatttgttggaattgatgaaccaatattgatacattgtgattaactgaagtttatatatcaattatgaattgatatacttgttaacactaatataaaacagtaataacaggggaaactatgtttgtaatgggagagagggcacatgggaactctgtacttcatgcacaatttttctataaacctaatactgctctcaaaagtctattacaaaggaaaaaattatgtccttgtaatcttttgagactgcttttcacttaattaacacacataagattcagccatattttatggctatcattcattcagactattatatgatattccagtgtataaatatactacatttgtctgatttctcattaatggatatttgggttgcttccaggtttttatactgtgaataatgctgctatgaacattcttttttttttttttaacctttctttatttttatttttttttttgtttttgagatggagtcttgctctgtcatccatctagagtgcagtggtgcaatctcggctcactgcaacctccgcctcccgcattcaagcgattctcctgcctcagcctcctgagtagctgagactacaggtgcccgccaccactcctggctaatttttgtatttttagtaaagacgaggtttcaccatgttgcccagggtggtcttgaactcctgacctcaggtgatccacccgccttggcctcccaaagtgctgggattacaggtgtgagccaccacgcccagccagctatgaacattcttgtgtctcctgtgatagatgtggaagagcctttcacccctcagccattagaccaccagggagtgcaagagcttttctttgatctatttggatctatacctaaaagtgaaattgtcaggtaacagggtatatgaacactccattttggtgggtaacatcaaacctttttcccaaagtgaatacacaaatttgtactcccatcagcatcgtttaagagactctgtgagcggatccacattttcttcagtacttagttttgtagtctgacaatcaaagtattagctcaatgtggtcttaatttttacttaatcaataaagttgaacatctcctcatattctgttaaccataagtttcctcttctgaagcatgcccattgatatcttttgcctatttttctattatgttatatgtgcttttctcaattttttaggaatttttgatgctaattctttgttatatatgtatattacaaatatcttctcctagtttgtaacttgtccctctctttttaaaatgcttttgatgccaggcatggtggctcacacctgtaatcccagcagtttgggaggctgaggcaggtggatcacctgaggtcaggagttcgagaccagcctggccaatatggtgaaacctcgtctctacaaaaatgagccaggagtggtggcatgtgcctgtaatcccagctacttgggtggctgaggtaggagaatcgcttgaacctgggaggcagaggttgcagtgagccaacatcgctccactgcactccagcctgggcgacagagcaagactccatctcaaaataaataaaataaaatggttttgatgaacaaaagcttttaattttaaaatggtcaaatatctttatcttgagtgtatgtgtgtctttgtttaagaaatgtttccctacctcaaggtctaaattatagattataaaagatactcatccatagaaactaagagttttaaaatttgatattttcagggatcccaggaggataaaaaatatataaataaaaaatgcaactttgagccgggtgtggtggcccacacctgtaatctcagtacttcgggaggctgaggcgggtggatcacttgagatcaggagttcaagaccagcctggccagcaccccttctctactgaaaatataaaaattataaaaatataaaaattagccaggcacctgtagtccggctacccaggaggctgaggcatgagaatcacttgaacctgggaggtggaggttgcagtgagcccagatcacaccactgcactccagcctgggtgacagaatgagaccctgtctcaaaaaataaaataaaactttgatatttggagtcattaatctacctgaagttaaattttgcatatgtgtagggtagggatccaattttaaattttccatacggataagcattattttcaagctctattgaacaccctccaccaagttgatctaacatgttccctgtgttattgtgcaatttgagtcctttaagaagaagatcacaagaaactaaatgtgcaagagatggactgaaggaaaatcttgtaaaaaaatgaaaggaggagggaaatggaatagtcaaggatgcccacagttcaggttggacacctgtgaaaatagagaaggaaggagggctgaatgggaattgtctcagacttggtgcagctttgagaaagccctggctagccctgtggggagccccagagcaaagactgccccctagaggagtcccatggattctagctccagtacctccacaatctcagtcactggctgaaagcagttctgggagagcctgctctgggagagtagtcacctgaatactgccatggacatgaagacgcagcacttggaggttgtccactaactacactccttgcagcaggttctcttggagggaggtctgagcagcacagcttcatggccaccagggataccagagtttcatatagactgagtttattattattatggactccaatggagtagtccattggccaacttgtctatgcctgtgccaataccaaactacagcttcattataagttttcatcctggtagggtatgtctccttcttgctcttctttagaagggtgctggctattcttggtccctcactcttccatatatattcaggggttttaagcagaggactaacatcagatctgtatagtagcaggataactcaagcattagtgtggggtattataggaatgaaagatagcaggctgagagaacttctgggagattatttcaacagtccaagtaagagaaaaggaggtatatgttgagtggatttaggcagtatcagtgagaagagtctgaagattatggatacaagagaacagggcagaaggatgagagaaaggggaaactgagataactcccatgtttgtttgagatggagtctcactctgtcgcccaggctggagtgtagtggtgtgatctcagctcactgcagcctccgcctcccaggttccagcaattctcctgcctcagcctccctggtagctgggattacaggcacatgccaccacactcagctaatttttttttttttttttgtatttttagtagaggtggggttgcaccatattggccaggctggtctcaaactcctgaactcaagtgatctgcctgcctcagcctccgaaagtgctgggattacaggcatgagccactgcgcctggccaactcccatgttaatggcctggctgactgtctagactggggctttttttttttttttttttttttttgagatggagtcttgctctgtcatccaggctagagtgcagtggcgtgatctcggctcactgcaaccttcacctcccagattcaagcaattctcctgcctcagcctcctgagtagctgggattacaggtgtgtgccaccatgcctggctaatatttttctatttttagtttcaccatgttggtcaggctggtctcgatcttctgacctcttggtctgcccacctcggcctcccaaagtgctgggtttacaggcgtgagccaccatgcctggcctagactggggcctcttattgagtcagggaatatgggagaagaaacaggttgtagggaaagttcatttggttttgtacttgcttgtggggcatgtattttaagctgtccattgtataaatggacatagcagtctggagctcactcagactggctttgggagtaataaatctgcaggtgtagtttaattttagtattagagaaaatattccctggggaaggcatggacgaggagtggactaagaatcctggaggttgccgacatatgagaagtcagaagaggaactacttaaaaacttgataagaaacaaccaaaggggctgggcatggtggctcacacctgtaatcccagcactttgggaggcaggtggatcacttgaggtcaggagttagtgagaccatcttggccaatgtggtgaaaccccatctctactaaaaatacaaaaattacctgggcatggtggcacacacctgtaatcccagctacttgggaggctcaggcatgagaattccttgaacccaggaggcagaggttgcagtgagtcaagattgtgccactgcactccagcctgggcaacagagccagactccttctcaaaaaaaaaaaaaaaaaaaaaaactaccaagaggaaagagcatcacacccaccaggatgactactactgacccaaaagggaaaatagcaagtgttggcatggatgtggagaaactggaatgctttgtgcactgctgctgggaatgtaaaatggtctagctgctgtggaaaatggtataacagttcctcaaaaaattgaaaatataattaccatatgatccagcaattctacctctcaaaatatacccaaaagaattgacagcagggtctcaaagagacatttgtacctccattgctgtcttctgagtttgtcctcccaaaattcatatgttaaaacctaaaccaaggtgatggtattagaaggtggggactttgggaggtaattaagtcatgggggtggggccttcatgaatgggattagtgcttttattaaaaagaccttgaagtccagcatagtggttcacgcctataatcctagcactttgggaggctgaggcgggaggattatttgagcacagaagtttgagatcagccagagcaatatagtgagatcccatctctaaaaaaaataaaaaattaggctgggtgtggtggctcacgcctgtaatcccagcactttgggaggctgaggcgggcagatcgcctgaggtcgggagtttgagaccagcctgaccaatatggtgaaaccccgtctgtattaaaaatacaaaaattatccaggcatggtggcgggttcgtgtaatcccagttactcaagaggctgaggccggagaatcgcttgaacccaggaggtggatgttgcagtgagctgagatcctgccactgcactccagcctgggcaacagagtgagattccatctcaaaaaaaaaaaaaaaaaaaaattagccaagcatggtggtgcatgcctgtagtctcatctactcaggaggttgagatgggaggattgcttgggcccagaagatcgaggctgccgtgagccatgattgtgtcactgcactcaaaccatctacaaaccagaaaacagctttcaccagaacccaatcattctggtgctttaatcttgaacatccagcctccagaactgtgagaaataaatttctattgtttagaagctatccaggctgggcacggtggctcacgcctataatcctagcactttgggaggtcaatgtagaaggatcacttgaagccaagaattcgagactagtctgagcaacatagcaagacccacccccccaaatctgtacaaaaagaaaaaaaaattatccaggcatgatggtgcacacctgtagtcctagttgcataagaggctcacctgagcccaggaatttgaggctgtgatgacctatgatagctccacctcactctagccgcctaggcaacagaacaagactcttgtctctaaaaataaaataaaaaataaaagcgtccatttgttcagagggcaaaaaaataaaaagctatcgcatttagtgtattttgctatagcagcctgaatagactaagacatcttatattcacagcagcattattcacaataactgaaaggtggaagcaatgcaagcgtccatcaaatggacgaatggataaataaatgctggtatatgcctacaatggaatagtattcagctattaaggggaaggaaattctgatgcttgctacaacatggaggaactttgaggacattatgctaagtgttataagccagtcacaaaaggacaaatatatgattccacttgtatgaggtacctagactagtccagttcctagtagcagaaagtagaatggtggttgccaggggttgggggaaagaggactgaggagttattacttaatgagtatgatacttcagtttgggaagatgaaacaagttctggaaatggatggtggtgatggttgcacagcagtgggaatgtgcttaagccactgaactatacacttaaaagggattaaaatggtaaattttatcttatatgtattttaccactacttttttattttttatttattttttatttgttttgagacagagtctcgctctgtcacccaggctagagtgcagtagtgcaatctcaactcactgcaacctctgcttcccgggttcaagtgattctcttgcctcagcctcccaagtagctgggactacaggcatgtgccaccatgcccggctaatttttttgtatttttagtggagacagggtttcactgtgttagccaggatggtctcgattttctgacctcgtgatccgcccgcctcggcctcccaaagtgctgggattacaggcgtgagccaccgcgcccagcaccactactttttaaaaggctgtgatggagatttctttaagaagattaaatttaaagaatacctaatttatttgatcttactgaaaggaaagcaaacaactgagggataatttggggatatcttaataataagtacctagaaaaccaagtgaacagaaaataaggaatttactaactctccttttttttttttttgagatggagtctcgctctgtcacccaggctggagtgcagtggtgtgatctcgctcactgcaagctgggcctcctgggttcacgccattatcctgcctcagcctccggagtagctgggactacaggagcctgccaccaggcccagctaatttttgtatttttttttttagtagagacgggggtttcatcgtgttggccaggatggtcttgatctcctgacctcgtgatccgcccacctcggcctcccaaagtgctgggattacaggcgtaagctaccatgcccggccgaaatttactaactctttaagatgaaagttatataggaaaggaaaagtgattatgttgcattatttggctcagctgtagatagcagttacagggtcataataacatacacatgaggccagggcaggccgaccatttgaggtcaggagtttgaggccagcctggccaacatggcgaaaccccgtctctactaaaaatactaaaattagccgtgcatggtggtgggcgcctgtaatcccagctactcaggagactgaggcacgagaatcgcttgagctcgcaaggtggaggttgcagtaaaccgagatcgcgccattgcactccaacttgggtgacagagtgagactccgtctcaaaaaaaaaaaaaaaaaagaaaaattctgcaagtgattcccattacccttgggataagttctcgcatccctatagaggctccccgggcctcacctacttcatcagccagagccctattcagcatgctgagaggcacaagaattgcttgaacccaggaggtggaggttgcagtgagctgagatggcaccactgtactccagcctggcaacagagcgagactgtctcaaaaaaacaaacgaacaaaacaaaaaacaaaaaaacaactacacacagcgccccacttatgattcttcaactttgcgatggtgcaaaagcaatagcattcaggacacgcctcaacttacaatgaggttatatggggataacccagttgaaaatactgaaagttgaattcctacataggatattttcaatgttcaatgggtttatcgggaggtggagcatcccgataaacccataagcaggggagcatctgtaccataatttctgttttcctcactggaccctgactgatacgcggatccattatatccactttaaagacaagagaagtgaggctcaaggaaattaagaagcacaccaaaggtcactgctgcacagggccctggctgattctccagcctttgccatactccatattaccactattaagctacatatcaacagacaattgtcctctatgaaaagcagattgtcacaggttattatgacaattatttgaagctgatgtcgccgtgggatgggctctgttctgcatcctgaaggctgcggctggtgagacagcagagggagctctgtccctaaggagacagcctccaacctgctggccccgccgggaataagggcacctcgatacctgtcgtgattaaaagatttgggtaagttcttcatcctagagaaggtaggctccttgaagggaagggaaaggaagcaagggaacacgtattaggctccaggaactgtgttaatttgatttttaaaatgttaaacgggaactgcgttgtttgaagcaggctgtcctccaggagcaggaatacagggccccttcccgtcctcctcccaccccacgcctgatttcacccccaagttaaggggagcttctctgaagtgggctacactggccactggacagttactgagtaaaagggacctcggataagggtgtggttctcctccctggatcccctgatgccacctcacaggagcactgaagggcagctggcaccctcactggagagcgagcattctcattctcccttctcctcccgagacctgcaccagctttgccttggctccaggggctgtcttgttcttgctcttgctctctgcatccattcttccagatgatgatggatccctgtgaaactgacttgtcccatatcacagaccagcatctgagactcaaatctgagcatcagggaagtaaaccttcaaccttggaacctgtacacagacctcacagcttgatcaactcagacacagagggcagctgtgggtccagcccagcctatccactctctctagtgggatttggaggaacactccacaatcccttggctggccttccatttaccctccattgcctgctttggaactaggtctaggtagacgtgactggccggaggtagaatatggccatttctttctttctttctttctttcttttttttttttttgaaatggagtttcactcttgttacccaggctggaatgcaatggcacaatctcggctcactgcaacctctgcctcccgggttcaagcgattctcctgtctccgcctcccatgtagctgggactacaggtgtgcaccaccacacccagctaatttttatatttttagttgagttgggggtttcgccatgatggccaggctggtctcgaacttctgacctcaagtgatctgcccacctcagcttcccaaagtgcggggattacaggcatgagtcactgtgtctgactgaatatgggcctttctgattcccctaaacaaaatgctatttcaaaacaagaggtaatatgttactcatatatatatataaatatataaaatgatatatgatgtatatatatcatatgacattgtcaagaataaattgaattcttaggaattcaccacccaacctaagaatgaataagtcacccacacttgatatctgtatgttccatctctctcatctgtttcgcctccagaggttctgagtttgtgcttctaatattttcttatttaaaatactaatttatcacaattatatttatttattttgagacagggtcttgctctgatgcccaagctggagtgcagtggtgcaatcatggctctctgcaacctctacctcctgggctcaagtgatcctcccatctcagccctccagtagctgagattacaggtgcgtgccaccacgcccagctaatttttgtatttttttcagagatagaggtcttgccatgttacccaagctggtctcaaactgcctgcagtcctcccacccttggcttcccaaagtgctgggattacaggcatgagtcgttgtgcccagacaattgtatttattattgaattacatgagcacttttttttttttcttttgagacagagtctcattctcttgcccaggctggagtgcaatggtgtgatctcggctcactgcaacctttgcttcctgggttcaagcaattctcctgcctcagcctcccaagtagctgggactatataggcaggtgctaccacacccagctaattttttttgtatttttagtagagatggggtttcaccatggtcaggctggtctcaaactcctgacctcagatgatctgcctgcctcagactctcaaagtgctaggattacaggcgtcagccaccgcacccaaccacctggctaattttctgtagccacagggaatctcactgtattggccagggtggtctcaaatttctggcctcaagtaatcctcccatctcagcctcccaaagtgctggaattaggcgtgagccactgcacttggccaaaggcaagatttgaaaaagaaatgaaactttaaaaatgtaaaacaattgtttaaacaaacataatggttaaacaccaaatttgatgcagatattgagaagatgagtgaactggaggagagatctgaagaaatcaccctgcctgcaatggggacaggaaggaggtgggaaacacagaagagttcatggagcagggaggagagaataaatttaatattcattagattgcagtctaggagagggcagagaaaaagaacaagagccaaacagctgaagaggaaatatagccaaagagaaacaactgagaattttccagaatgtaaaagacacgcatccttagatgcatccttacattacagaatgtagaagacatgcatccttagatgtcagggtatccatttgccagcgctgaactaacaaagcaccacagactaggtggcttgaacaacagaaattaattttcttaccactcgggagtctagaagtctcatgtcatggtgtcagcagggttggtttcttctgaatctctctccttggcttgcacgtggctgtcttctccctgtgtcttcacgtggtctcccctctgtgtatgtttgtgtcttaatctctttctataaggactccatcatattggattaggactcagcctactgacctcatttaatctaattacctctttaaagaccctatctccaaatacagccacattctgaggccatgggggttaggacttcaataggtgaatttggtggtgggaggggaacacaattcacaattcagcccataacaataggaatcacaatacatactaggtgaaatagatgaaaagaaatccacacccgacacaatatagtaaagctgcagaacaccaaagacaaagagaaggtcttcaaaacaatccgagagaaaagccacaccctgcttaacagtggagtggctccccacccaccatctatatttcttttttcttttttcttttctttctttttttttttttttttttttttttgaggtggagtctcactctgttgcccaggatggcatgcaatggtgcaatatgggcttactgcaacctccgcctccctggttcgagcaattttcctacctcagcctcctgagtagctgggattacaggtgcccgctacgatgcccagctaatttttcttgtatttttagtagagacggggtttcagcatgttggccaggctggtctcaaactcctgacctcaaatgatccacctgcctcagcctcccaaagtgctgggatgctgggattacaggtgtgagtcaccacacctagcctttttttttttttttttttttttttttttttttgagacagggtcctactctgttccccaggctggagtgcagtgacataatcatagctcacttcagtctcagtcaatcctcctacctcagccccccaagtacctgggattacaggtacacgccaccatacctggctaatttaaaaaaattctttgtagagacagggtcttgctatgttgctgaggctggtcttgaacttctgggctcaagtgattctcccatctcagcgtcccgaagtactgagattgtaggtgcaagccattgtgcctgctgcccccaaccacctatatttcaaatactcccactggcatttatgattttttattttttatgttatttatttgtttgtttatttatttattttgagacagagtatcgctctgtcgcccaggctggagtgcagtggcgctatctcagctcactgcaagctctgcctcccaggttcatgccattctcctgccttagcctcccaagtagctgggtttacaggtgtccgccatcacacccagctaattttttgtatttttagtagagatggagtttcactgtgttagccaggatggtcttgatctcctgacctcatgatccaccctcctcagcctcccgaagtgctgggattacaggcgtgagccaccgtgcccgggcgatttttgatttttttggtaccacagccctaccccttttccccttgtgaaagacataagcttctgactccatctaggttgatccagtactgtttcctgaacaggtggcgggcgcctgtaatcccagctactcaggaggctgaggcaggaggattgcttgaacctgggaagtagaggttgcagtgagccgagattgcggcactgcactccagcctgggccacagagccaggctccgtctcaaaacaaacaaacaaaaacagatgttgtgttgcaggtagctaaagctgccaaaggggtctgggtatattcagtgtgggagatgggcgttggtccgtattcctggctggggaaaagaaaggtggtatagacctttcctataccaggtgatatacagagttcatagttttgccaagggttccaaagacaggtgtcggtggtgatgacaagtcatctctgcttcctctaactctagtgctcttggtcaccaatgcctgaggcctggaattttataatttaattcgtcatgtgggggtgtttggtctccccagtgagacaggtgtctgtcttaatgtgtcccataacccctattgcaccagatgtttgtctctgcactaggccgttgcccgagagctcaccggggaatgagttagttggggacccctggagaacctttgtgttctggagcctacagagggctctggcctgccggaggggactgataacagctgtacatctgctgctgcagcctctgcctccaccagcatcatcttttgcaagggaaactgcagtcttctccattggcctccctcctttcaatgcattctccacacagcagtcaagtgatctttttgaaaagataggaatcaggctatgccactgttttcttaatgtcttctgtggcctcccatagcattcagaatgaaatccaaactccttgctgtggtctatacaaacctgcaggagatggcctattgccttagtttcttctcctcttgcccactctgattcagcctcctgggtttttttcccagttcatcaaatatgccaagctctttcccaccccagggcctttgcccttgttctttctgctttctttttcccagagctgggctgttgtcatctatcaagtcaccgctcaggggtcaccttcctcatctcctatagaaagtggattccccttgttactctctatttcatcactgtttctttctttcacgtgctaatcataagctgatatggtttggctctgtgttcccacccaaatctcatctcggactgtaattctcacatgtcaagggaggaacctggtgggaggtgactggatcatgggggcggtttcctctatgctgttctcatgatagcgagggagttctcatgagatctgatggttttaaaagtggcagtttcccagttagctgggcgtggtggtgcacacctgtaatcccgggtactcgggaggctgaggcaggagaattgcttgaacctgggaggcggaggttatggtgagccacgatcacgctgttgcacgccagcctgggcaacaagaatgaaactccatctcaaaataaataaaaataaataaataaataaataaataaataaataaataaaagtggctctctttctcccgctttgccatagtaagacatgtctgcttccccttcaccttctgccagattgtaagtttcctgaggcttccccagccacgtggaactgtgagtcaattaaactattttgtttgtaaattacccagtctcaggtagtgtcttcatagcagtgtgaaaatggactcatacataagctctatctatttggtttgcttgcttgtttgtgtcagtctccccaactaaaatctaagctccaccagtctcctgttgtccattgtacctctaggtcccagcagagtatctggtgcatccagtaggcatcacagtaactggtggaaagcatgccaggtgctatctggcctaggccccggaccctgtagcacacctctttgtggaaactcaaaacccggcagagttaccagagctgtacctgtgacccagtgcacctcagctcccaaccatccagtatacagtcagaatttcaactggtcccagcagccgaaaggagtggaaatgcagagctagcaacagtttacctccataaattcgactccctgttgctcctggtattaactctggtttcatgcacttccactccaatgaagacttggcacatttcaaaatacctctgcacagcaggacactgattgaattcgaggtgctgggaagccagttgaagaatataatggtaaaatcactggtcgctttatattgtagtaaagaacttgaacaaacaactattacacctcctttaatgttccattctgtttcaagtgaatctggaataagtatagtaacttatactgcttttaacctgccccattagacttgtccactttggcccacggtgcttttgatttgaggttccagtctgtctctcagcagcactgtttgtacataacgtgggtccagtttgtaacatttgtaaattttgaaaatgtgtttgagttattcaaatggttgtttgcctatattttcaaatataaaacctctgagcaaatatgtaattatttattttattttattattttattttattttatttttgagatggagtctcgctgtattgcccaggctggagtgcagtagcgtgatctcagctcactgcagcctccgcctcccgggttccagcaattctcctgcctcagcctcccgagtagctgcgattacaagtgtccgccaccaagcccagctaatttttgtatttttagtagagacggggtttcaccatgttggccaggatggtctcgatctcttgacctcgtgattcgcctgcctcagcctcccaaagtgctgggattacaggggtgagccactgtgcccggccggtaattatgtattttaaatgttcccatttggtcatataaattacggtacatccattcaacaaaatactgcccagtcattttaagagtgtgggggaattaataggcattaacatgctcaagattattgttaagtgaaaacagcaagttgcagagcattaagtataacatctctctgtgtataagtgtgtgtaaatgtgttttcttataaacaaggcttatttttggaaaaagactctaagtcatctctggatgtacaatggctatcatggtaatcgctaacatatatcacatgcttgttctctgccaggcattgcaccaagtgcctttcctatccttcatttaatctacataataaccctaagaggaaggtattactattatcttccatttatagattaggaaactgaggccaggagaagtcaagtgctcaacttcagcattctatactattcgttgtgggtttttcttttttaaatgtatctgcattacttttaaaataaaaataatactattaaatattttaaaatcttcccctcttctgggattttgaaactgagagtggcaatagaactgttcagtgccaagttctgttgtggcagtgaatgaaaacccaggttgtgctaggtgcagtgggccagtggctcacgcctgtaaccccagcactttgggaggctgaagcaggaactttacttgagctcaggagtttgagacaagcctgggcaacatggtgagactctgtttttacaaaaaaattaaaaattagttgggtgtggtggtacatacctgttgtcttagctactgaggtgaatgagatgggaggatcacttgagcccgggagatggaagctgtggcaagctgtgatcatgccgtggcattctagcctgggcaacagagcaagatcctgtcttataaaaaaaaaaaaagaagaagaagaaactcaagttgtgtcacttctaggcaggcgccctttttctcacagtctggtgtggagaggtggttgagaagcctctaggctcataggcagagctcagtagaagcaggaggaggaaaggtcaagttggaggccctcaggtactgctgcctctggttttctgagtgtaattatggatgggctgaccccactgcctaccgtggtgacactaaggggagtctccaaactgaagggcagcactgccccccaagtagccagaaaaattcaaggtcagttgttagctgcaaccttttatccaatagcatctggaggcatctggataagatccattaaaatactcattgtgatgccagacctcatacgaacattcatttgacacccacaactactcataagcctgattgtccccatttgaacagtgaggtttgtgaaattaagtgatgtaagtctcacaaacaactgcaagtttaggactgacttgaccttaggactgtctggcgctccactaattcccacgcgggggcgctggtggaggagctgatggcagccagatgttgcagtttttgtatgttgcgccctcccttattaagtatccttcacccaaactgtgtgatatggcttggctgtgtccccattcaaatctcaacttcaactgtatctcctggaattcccatgtgttgtgggagagacctgggggaggtaattgaatcatgggggcttgtcttttccgtgctgttctcatgatagtgaataagtctcacgagatctgatggtttgatcaggggtttcctcgtttgcttcttcctcattttctcttgctgctgccatgtaagaagtgccctttgccctccgccatgattatgagacctacccagccatgtgaaaccgtaagtcaaattaaacctctttatcttcccagtcttgggtatgtttttatcagtagcataaaaacggactaatacactgtgaaacatataaaaaatgaacaacgttgggcgtggtggcttgcatttgtaatcccagctactcaggaagctgaggtgggagaatcgcttgagggtgagagttcaagagcagcctgggcaagagagcaagacttgtctctaaaaaatttttcttaaataagaaatcagctgagtgtggtggtgcatgtctgtagtcccagctactcaggaggctgaggcagaaagatcgtgtgagctgtggagttcaaggcttcactgagctgcgatcacaccactgcactccagcctgggtgacagagcaagaacctgtctctgaaaaagaaaaaagaacaaatagaggcatctgcttcatggaccagccttcaaaaggagcctctgttgtgctcccaagtcattttcacactggaagaagagtcagcaaggtggcacctgttatcaaatcagcccgctgctacctccctaatgacctccaaaactgccctgaaactcagagacgttccaggattgattgctgtgtgtcctgaagtttccctctgggctcaggttcctcagcttccatgaactggctgtttggacacctactgaaccctaattctattagtaataccgaggccccactgtaaactaaagattagaaatgtaaaggcttggcctctgcaaacctcggggagactcactgggcctgaatcccacaccctagaagtctggtgtcttgaacccaagattttggggcagtttctgaaggactttctgatgctaaaaatgatggtgaagggcaaacgtacacccagttactcccagggcactccctttcctgtacttgaatactgggctggctagactcagatacacatgcacggacaaacatacacacacacacacacacacacacacacacacacacactcctgttccatatctttgggtctctgcttgctcttacccttgcttcgaatatcctttccaccttacttcacacagctgactgttgcttaattatggagattcagctcggggatcacttcctcaatcccaagctgggctaatgttttcacagcaccagggttgagcaccatctcagcctattacataaaatggcctggtaatacatctcctccactgaaccaaaagtctctgaggatggggcccacgttcagctccctgtggttctcagagtctcaccggatgtctgccgcgctgcaggtgctcagcacaggtttgtggctctgtccagcgattatattctcagcctacaggcagcctcttccttgtagcatggccaggttcccatcgtgcagactcattacatccgtgccagggcttgtaagtttgccgcttatctgaggttcatctgcaagaagctgtaattgaaacagcttccaggatggaaatatcgtttccagaatttcattttcaagcttacagcctggatcgttcaagccgattacaggaaacggttgcagtgctggtgctccccgggttgaatccagatgggtgtgtttactaggctgagaaatgttaatcctgtctttggcctagaaatgtctggcattcactttggagggaaatagaaaaataaggtagtacagccagccaggctcagttatatttcccttaaataatgcttttttcaaaacaaggtggggagagggtctgctggagggacctttgcctgaaaggagatagtgtgcaactgtcattgattttgaaagttcagaagaaacattctgaatagtcagtctttagtatcattacaaggctggccaaataaccatgggcctgaatgctgacaggtgcatgcttggggctaaggaacagagatctgaatctgttctcttctgaaggccatatgtaagcgtgcatgaagccaaatgacaatgagaggaagggcctgcacatttactgagccctggcttctttgccaagcattgtactaagcacttcacattttttatatcgtttgatccaataactctttgaggtggataccactactactaatcccatttacagttgaagaaaccaagattcaaagagaggcttgcccaaagtagcagggctcccatatgctttgcaaacacttttataactttaaacgattttttaaccctaccacgtgccggcactacaaccagcccagctggcgggtggtcactcctgtcctgtgtagtgaagacccaagatcctctggcaagtgctcccaggcagcagggcagtggggcccatttgtccctaataaacctttcttccatgcagtgctcaaactcctcaagaaagcaaaacacaacagcttcagtaactaaataggcgaccagtaacctgcctgcccagagctctctgagactttttgtttttttttttgtgagatggagtctcgctctgttacccaggctgcagtgcagtggcgcaatcttggcttactgcaacctccacctcccgggttcaagcaattctcctgcctcagcctccagagtagctgggattacaggtgcccaccaccatgcccggctaatttttgtattttagtagagatgaggtttcaccatgttggccaggctggtcttgaactcctgacctcaggtgatccacccgccttggcttcccaaagtgctgggattacaggcgggagctaccgcaccctgcctgagactttgtcttcagttacaagtgcagtgagtgacgaggggagggaagagagctttttgaagccatatgaccctggcatgtatttctgggcctcgcgtagcaccttcccacgggtgctagagagacaggagaggaggaaagagcctccctctttcagtcaagagtgccaccttgtgatgccagcaccagaaaagaactgaacatcactctggcccctgagctcagccctgtgattcatccccacagcccctccctggcagtaggctctgtttgtggtgctctgtaattagttaatgaactatctgaatgatattcctgtagtcattcaaccagccccatcctcagggtgtaattgtatttgaggttatttaaaaacattattgtatccaaatagagtttacatcagcagacagcatgattcgtaattctgctatccctggtgtttctaaattgtgctataaactgcctgatgagtcgtgcaaaaatggctgcaccaacagagaacagtggggcttctctggcaaaaaccaccaactatctaaggggaagagtagtaaaagcaacttgtggctagaacccagttgacttcagtatagaacagattgttttcaagaggccctccactaatttgatcatcatctttggatgaactaactcttcattacctttacaagaaaatgcttggaaaggaagtggaaggctgatctgaagagtggcaggggctgcttcacttcctctgcagtttcctggagctgccttgctccgcctcagggaatttgctgggagaggctctccagcatccagatccccctgcaaaggtgtttcgcgatctgcaggaacaggccccaggagcatcccttggggccgaatgtgcagtgggcgatgcccctcctgacccaacagatccaagacgagcatgatcaatacagtcttgtggccagccttgacaatgttaggaatctctccactatcttaaaagctattcatttccgaaaatgtgctgtgtgtttcgcaactaaaaatggaatcaaagtaacaatggaaaatgcaaagtgtgtgcaagcaaatgcttttattcaggctggaatatttcaagagcttaaagttcaggaagagtctgttactttttgaattaatttcattgtccttttagactgtttatctatttttggatcaagtcctatgccagggacttgaactgcacttcggatgtgttaccaaggttatggttaccctttgatgctgttcctggaagaagaaggagtggtggcagtctgcaaaatcaatacacaggaacctgaagggacctggactttaatttctacagcactaatgttattgataaaattctgcagtcagaagggctctgtgaagctttttctgaattggatatgacgagtgaggtcctacaaattaccatgtctcctgacaagccttatttcaggttatctacttttggaaatgtaggaagttcccaccttgaccgccccaaagattctgatttgatggaagcattataatcagacccaggtcaacagatgcaagatttccttactgaaaccctctacaaaggcattagtcctgtcttgtcacgtatctactcggacagataaccgaggcttcctttcattacagtatatgattagaaatgaagatggaccaatatattttgtggaatattactgctgccctgatgaagaagttctttaatctgagtcttgagtatgacgattcactgatatttatgtgtacattgatgatagatgaagttctcattctgagtacggtactttttttttttttcttttttgagatggagtctcactctgtcgctgaggctggagtgcagtggcgccatctcagctcactgcaacctccgcctcccaggttcaagcgattctcctgcctcagcctcccaagtagctgggattacaggtgcccgctaccacgcctggctaatttttatattttagtagagatgaggtttcaccatgttggccaggctggtcttgaactcctgacctcaggtgatccacccgccttggcctcccaaagtgctgggattacaggcgtgagccaccacgcccagccttgagttcagtactctttataatttcatattgtatttcctatagagaagaagcatggggaagatagaaacaaggtctgtgtaccctaatagttgctatgtgttttgtaaatacattttgtaaagggcatgtaaataaatgttttcatgtagtcataaattattcaggactgtcctgtagttctgtcttttgaactcatgggaatgattatgaaccaagattaataaattatacgttctatttcagtagaacatttcaagagtctaaagacttattcagctacctgaaatgttcttttatttatttactattagaaaaggcaaaggtatatgctcattgcttattagtttgaattctagagactagatcttaaagcagtgcttctcaaagtgttgtgcccacaccagcatcagaaccacctgcaaacttgtagcaaactctggggaggaggccagcattctatattttaacatgcttcccccaggagattctgacgcatgctaaattttgggaaccactgttttaaaggaaactttttttaaaactagcatttaattgtattgagatgattgcttttacatgtgatttctttgcaaatgttctgaagttgaggcatcaccaaacaagtctgaacaattctttatgtgatttatttttaaagtagaccttctgaggagatctatgaatgggatataaaataattttcaggccaggtgcagtggctcatgcctgtaatcccagcaccttgggaggctgaggcaggcagattgcctgaggtcaggagttcaagaccagcctggccaacacagtgaaacctcatctctactaaaaatacaaaaattggccgggtgtggcagtgcatgccagtagtcccagctactcaggaggctgaggcaggagaattgcttgaacctgggaggtggaggttgcagtgagccaagatcgtgccactgcattccagcctgagcaagagagactctgtctcaaaaaaaacaaaaaaacaaaacaattttcagagttacaggttttcttcttgttctcacaactgttcattccagtaagtaactgcagtaagtacttattagacaccttccatttgcttataagtttcttggcaaatcaagctgtagaaaaccagttattaagtgattttgtacttttctggtagtcgtcactaaaataatttttgtggcatataaatatttttatatttaataaagtacaatactaaaaaacagaaaatacatggacaccaatcttggtctgcctttctttactatctgttttgcagataatagagtaatacagttaaaagcatgggaatggcttaatgaatatctcccagccgccatttctttgtctgtaaaatggggattacgggctgggcgcggtggctcacgcctgtaatcccagcactttgggaggccgaggtgggtggatcatgaggtcaggagttcaagaccagcctggccaacatagtgaaaacccatctctactaaaaagatataaaaaattagccaggcgtgatggcggatacctgtaatcccagctactcaggaggctgaggcaggagaatcacttggaggcaggagaatcacttgatcccaggagacggaggttgcagtgagccgagattgcaccactggactccagcctgggcgacaagagtgaaactccatctccaaaaaaaaaaaaaaaaccaaagcttttagtacaacacccaggacaaggccactgcccagtcccgggtgttagggctttagaagtttctgcatagttttagttatttctgtatatcttgttttttttctatagcctcacaacagaggtgatatttatgtacgttttaatgctcctactactagattataaattccctgaaagcaagattaatgtttgcttcctttctatgtcttcacacttcttatacacggtaggaactcagtaaatatttgtcgaataaatgaacatattgatcctatatttaagtgaaaaaaactgcaaaatgtgctttatctgggcattaatgcaaaagttctcaagataaagttaatctgtagctgtaagtatatctgaaatctagaataatatatctatgtcagttgctaagagggtcaaatgagatgtgtatgaaaacctcttcaaaaatagtaacatagggccaggcgctgtggttcatgcctgtaatcccagcactttgggaggctgaggcaggtagatcacaaggtcaggagttcaagaccagcctggccaagatggtgaaaccctgtctctactaaaaatataaaaattagctgggtgtggtggcaggtgcctgtaatcacagctacttgggaggctgaggcagagaactgcttgaacctgggaggtggaggttgcagtgagccaagatcgtgccactgcactccagcctgggtgacagagtgagacttcatctcaaaaaaaaaaaaaacaaaaaaaaaatggtaacatagggccaggcacggtggcttacacctgtaatcccagcactttgggaggccaagacaggtggatcacgtgaggtcaggagtttgagacgagacctgccaacatggtgaaaacccatctctactaaaaatataaaaaaactagctgtgcgtggtagcaaatgcctgtaatcccagctacttcggaggctgaggcaggagaatcgcttgaacccgggaggcggaggttgcagtgagccaagactgtaccactgcactccagcctgggtgacagaatgagacccatctcaataaaataaaataaaataaaaataaaaaatggtaacacagcaaacataggtaatgtgttattggtttatataatatacatatataatacatagaagaaatctatatattatatatataaatataaatatatatattatatatataaatataaatatattatatattatatatataaatataaatatattatatatatataatataaatatattatatattatatatataaatataaatatattatatattatatatatataaatataaatatattatatattatatatataaatataaatatattatatattatatatataaatataaatatattatatattatatataaatataaatatattatatattatatatataaatataaatatattatatattacatatataaatataaatatattatatattacatatataaatataaatatattatatattacatatataaatataaatatattatatattatatatataaatataaatatattatatattatatatataaatatattatatattatatataaatataaatatattatatattatatatataaatatattatatattatatataaatataaatatattatatattatatatatgtatattatagagagagagagagagagggagagagagagagggatttcttcttctatgcttctagtggagcagctgctaattgcagggcataaactgcccctagtgtgtagttgggccaccaaccacacatgtcagcagtaagcaactagcaagtgcttatacacaagtgaatacaaagactttttgttgtaaagaaacaaaaaagtatattagtaatctactgctgcctaatgctttactccaaaacttagccgcagaaaacaacagcaaacacttatcatctcacagagtttctgtgggtcaggaatttgggagcagtgagtggttttaggttgactggggcaggaggatccatttccatggtggttcacgcacatgcatagtgagttggtgctgattctcggtgaaggcctcagctcctcccgggtgtggcctgtccacaaggctgcttgagtgtcttcacaacatggtgactggccttcctcagaggcagtgattcaagagaccacagcagaatctgcagtgtcttttatgatttgtcttcgaagtcacaaccatctcgtctggaatatcttattggtctaccttattcagtgtgggaagatacaataccagaaggcgatggtcatggagccatcttggaggctggctaccacaaaagggaactgatctcagaaatcaagaatggtagctacagcccagccaggcttcccagagacaagagctggagggcatcccaggagccagggcagctcaaggcacttcagtggcggccatccccctgtcttcactcctcctgttccttcctcttcatgtgactcagccacaccccttctctcttctcctgccagttcttcccatgtttcttagttcacatgcctaaaagcagagcctgatggttcatcttttttctcaggtcatcacaggtcacatgccagcctatgggttggttccaaggatccactctaagaccaggcataggggaggcaaggttcacatggtccaaaacatgggcatcttaccccagggctgtggtcaggacagtcttgctaagatgaaataataggtgggatgcagcttgggaagtgtggcctgccccatatggctactgctcaccaggcatcgtgctggatggaggggccacagatggggcaaagaaagaaaaatgggcagggcgcagtgactcacacctgtaatcctagcactttgggaggccaaggcaggtggatcacctgaggtcgggagttcgaggtcagcctggccaacttggtgaaactctctctctactaaaatacaaaaattacccaggcatggtggtgtgtgcctgtaatcccagctacttgggaggctgaggcaggagaattgcttgaacccaagaggcaaagactacagtgagctgagatcatgccactgcactccagcctgggtgacagatcaagtctctgtctcaaaaaaaaaaaaagaaaaagaaagaaaactgaagacccataaattgatccctggcctctctgtttagcgaggccataaccaaataatttgtgcatgataaggctgtactagatctctcatggcactatgagtgttgattccctctacctggggcccatggagaagtctccccaagaaactgctgccagggccttgaaggatgagctggagtttaccagatgaagagaagggagaatggcatttctggcaggaaggaacctgcacagggtattttggcggaaggtgagacgctgtaggtgggactggggagcagggcagctgggaggaaagctggcagggccagtagggtgatgctgtgatgaacttggtgggaccagcaaagagcttgggctctacccgagagcagtgggaagacctctaagtatctgaaacaggaacgaccaccgtgggtggctccaggggtgatagcaactcagaagggaagccgggtccaaggaggcacctgagcgtcctcccctcttcagagtccagttcacaaggagctgcctgtgatttttttggaaagctgtattctctgttacaaaaagacatccgagcttgtgaggaactaacgactgcccctccactggttcccttgaatagcaatccctccaaatataattccacagccatccaaattaagcaaagctttattaagcaccaagccggccacatctgcataatgaaaatatttcactggaagcctgagaaaactccctgtggactccttatcgaataacccctcatcctcctacaaatacctacccagccaattcagaaaataacatctggaaaagaaaccccttttttcagttcaggtcattccaatgagcagcttacagcagacttggaatttctacctcagggaatgaaggctgagtatgccagtctgaaaggcttattatttaaatgtcctcaggcggggctggacatgggcactcacagctgtaatcccagcactttgggaagccaaggcaggaggattgcttgagcccaggagtttgagaccagactgggaaacatagtgaaatcttgtctctacaaaaaaataaaaatattagcccggcacggtggtgtacatttgtggtcccagctacttgagaggctgaggtgggaggatggcttgaacccgtcagctgtgatctcatcactgcagtccagcctgggtgactgagcgagacccttctcaaaaaaaaaaaaaaaaatcctaaggccaattttatatcttactgaccatgtttatagagtgacttcagaggaaaaagcaagctcctgggcttttttttttttttttttttttgagatagagtctcactgtctcccagggtggagtgcagtggcacaatcttggctcactgcaacctctgctgcccgggttcaagcgattctcatgcaccagccacctgaatagctgggattacaggcacacaccatcacgccaggctaacttttatattttagtagagacagagtttcaccatattggccaggctggtctcgagctcctggcctcaagtgatctgcccaactcggcctcccaaagtgctgggattccaggcgtgagccaccacacacagccactcctggcctcttttactcagagaaatgagttgctctggtgaggtctggcctcaggtaaggggaccattacattgcaggaacccctggaagctgcatggcctgtggttaagaggccagcctctgcagccagcctgcctgggcttatatacccccgtgagacttgctaccgtgtgaccttgggtaagttccttgagctctatgtacctcggtttccttgtctgtgtaatgggaatgataccaataacacctctctctcagggctcttaagaggattaagtgaatcctctaaggattaacctcttagaagaactttacacagcgcagagaaagtaccatacaaatgtttgctattattattattactttagtgtaaatttactgatctgcaactttcctctcgttaaggtatacctacaacaaatttgcactttgaaatagctgtcctgatgttactaagtggagctaatcatttatcaccaagttctgttgcttttatttatttatttttttttattttttgagacagggtcttgctttgtcacccaggctggaatccagcactcactgcagcctcaacctcctaggctcaagtgatcctcccacctcagcatcctgagaagctgggactacaggtgcgtgccatcatgcctggctaatgtttgtgttttttgtagagatgggggtcttgctatgttacctaggctggtctcgaactcctaggatcaagcgatctgccgactcagccttccaaagtgctaggattacaagcatgagctatggcacccagcctgttgcttcttactctgaagaatagtttgagttgatctgattctctccagtataggtgataattgagcccatggggcatgggctgttatgggtggcagttaaccccaggagttcaaatcctggctctccattcaccagctgtgtgatcttgggtaagtttcttaacatctctgagcctcagtggtccctataaaatgacaaccacaatagtacctatttcataggtgtttgtgaggattgaatgagatcatgcaggtaaattgctgagcacagtgcctggcactaatatatattcaatcaaacccattcttgccccagccacatcatctctccctgaaacgttcatgttggcttttctttttccccctctgccttgccctctggcctttgaacttatatggaaacctggagtctgcttccaatcttaccctcctgcaaggcattctccacatggcagcgaaatgattttttaaaacacaaacctgatcatgccactcctctgcttaaaattctgcaagtgggccgggcacggtggctcatgcctataatcccagcactttgggaggcccaggtgggtggatcacctgaggtcaggagttcgagaccagcctggccaacatggcgaaaccccatctctactaaaaatacaaaaatattaactgggcatggtggtgggcacctgtaatcccagctactcaggaggctgaggccggagaatcacttgaactcgggaggcagagattgcagtgaaccaagatcgtgccattgcactccagcctgggtgacagagtgagattccatctcggaaaaaaaaaaaaaaagaaaagaaaaagtaagaaaaattctgcaagtgattcccattacccttgggataaattctcacatccctgtagaggctccccgggcctcgccagaggtctattcagcatgcgcctccctcagtggccttgtctcattccctgaaggttccttagcacagaccttcacacctgcagtggccatcgtttcttcccacactcttcctgccaagctaagtcccactcatccaacaagcctcagcttacatgtgacttcctcaagatgccttcctgacctcccaacttggagggttccctccatatttaatttctcaaggcatcttattctattccttcttagtgttaacaattgcaccaaaattattatctgtataatttgagtgtcagagtttgtgttgttcacagaacatccccagagtttggtgtggtgtccagcccatagtaggcactccataaatacttaaagattgggtggatgaatgagtgaatcaatgaacaaatagtggcattaccagcctgaggcctataaccgactctgcaagcaccattctgcagagccttgcttcactcggccctttcttggtttgtgggggcaaaaggacacgctgtttagaacccagcaggctgaggacaggcacccccatcacaaaaatcagagtcccaagtccttttagaagctgagacaatccagtcttctgctctgttaataaggccagtgaccaggagctcactcctacttgctagcaagttcttcccaatatcagccttaatcgtgtctccttaagagtccccacccatttgtgagatttttatttgtttgtgacttctgtattttctaatttttatttatttatttgagacagggtcttgctctgttatgaaggctggagtgcagtggcacaatcagggcttactgcagcctcgaattcccaggctcaagtgatcctcctgtctcagcctcccaagtagctgggattacaggtgcatgccaccatgcctggctgacttttttttttttttttttgagatggaatcttgccctgttgcccaggctggagtgcagtggtacaatctcagtttactgcaacctccgcctcccgggttcaagtgattctcccacctcagccttctgagtagctgggactacaggcatgcgccaccacgcctggctaatttttttgtatttttagtagagacggggtttcactacattggccaggctggtctcgaactcctgacctcaggtgatggcccacctcggcctcccaaagtgttggaattataggtgtgagccactgtgccctgccagctggctaatttttaaaaattttaattttatgtaagtacagggtctccccctatgttgtccaggctggtctcaaactcctggactcaaacaatcctcctgccttggcctcccacagtgttggggttacaggtgtgagcctccacatccagccattcaactttcatagagtatatataaattgcttttgtaattagagagaaagcaatacattttctaaagttctaactgcagaatctagttctgccctttatgttaacaataaaggcaaaaaaagagaaagaaccatattactggcctcctctcccacatcatgttggcaactgagtccagcacaagcacaccttggtctttgtgtttggacttgcctgccatttgcacatacagtgagctgccactaactagcaaatgctttccccagttttcaaaatgtgcctttaccagcctagtgttgaggcctgaaatagtcttggggctaccagtcctaaccctgagggcacaggctgcctcgccaggtatagagcccttgagggcaaagattgcctgctccagttcaagagtaggtcttggcatcctgtggccaatcaacagtacagaatagctggatgagtaacccacaggtttttgttttgttttgttttttgtttttgtgacggtgtcttgctttgtcacccaggctggagtgcagtagtgcgatcttggctcactgcaacctctgcctcccgggttcaagctattctcccacctcagcctcccaagtagctgggactacaggcacacgccgccacgcctggctaatttttttgtatatttagtagagacggggtttcaccatgttggccaggctggtctcaaactcctgacctcaggtgatccttccacctcagtctcccaaagtgctgggattacaggcacgagccacctcacccagctgtaatccacagattttgaatgaaattaatctggaacagaggaacttcagaaaatcgtaacaagttttccccaggtgcaagtgcattaagctccatgcctataccctataagaacaaccctaaaaagggccgagcgtggtggcttatgcctgtaatcccagcactttgggaggccgaggcaggtggatcacttgaaatcaggaattaaagaccagcctggccaacatggtgaaaccccatttctacccaaaatacaaaaattagccagttttggtggcactgtactcccagctacttgggaggctgagacaggagaatcacttgaacccaggaggcggaagttgcagtgagctgagatcttaccactgcattccagcctgggtgacacagtgagactccatctcaaaaaaaaaaaaaaaaaaaaaaaaaaaaaaaaaaaaccctaaagaaagcagcattatattgaatattgacaatggaaaataaaataaaataaaataaaaagaaagcaacaacaaaaaggccagaccaagacttgttagatgataagcttcctctattcaattgtttaatattttattttttatttttttatttttgagacgaagtctcgctgtcgcccaggctggagcacaatggtgcgatctcggctaactgcaacctctgcctcccaggttcaagcgattctcctgcctcagcttcccaagtagctgggattacaggtgtgtgccaccatgcctagctaatttttttgtatttttagtagagatggggtttcaccatgttgaccaggctggtcttgaactcctgacctcaggtgatccacctgcattggcctcccacagtgctgggattacaggcgtgagccaccatgcctggcctaaattttaaatacattttcaaacaagcgtatgtgttatatatcatttatgtacttaaaaattattaacatttaaaaaatcaaaatataaggccggatgtggtggctcatgcctgtaatcccaacactttgggaggctgagacaggagcattccttgaggccaggagtttgagaccagcttgagcaacatagtgcttgagcaacctcacctctatgaaaaataagaaaatcaactggatgtggtggtgcacgcctgtagtccaagctactcaggaggctgaggcaggaggattacttgagcacaggaggtcaaggtatagtgagctatggttgcaccactgaactccaggatggacaacagatcaagatcctgtctctagaaaacaaacaaacaaacaaaccaaacataaataaggaaaatggtgttaaatattctttctacttactaagaacaatgtttcttttcattagtgaaaagtaataaagttaaaccagtttggtctgtcagggtaaacagctgctccctggtagaagaatgtgatctttagacacaaacaacaacaaccaagaaaatcattaaactgaagccaagtttccagagggacccaggggaagtaatgaaaagaatccttcaaaatgtaacaacacattttctataaaatggaaatggctttggggaaatgttctgaggggtttgttcaccacagcttgggaaaagaaaaacgtgttttcaagcacagcaaaaagaacctgtgtccagcagccaagagatgatgcagaaacactggagtctgtaaaagctttgattctagaaaactttctttccttttttttttttttttgaaacagggacttgctctgtcacccaggctggagtgcagtgatgcaatcttggctgactgcaacctccaccctccatttctcaggctcaagcaaccctcccacctcaggctcctgagtagctgggactactggtatgtaccaccacagtacacactcagctaattttttaacttttttttttttttttgagacagcctcctgagtggctgggactacaggcacgtgccaccatggctggctaattttttgtatttttagtagagacggggtttcaccatgttagccaggatggtctcgatctcctgacctcgtgatccacctgccttggcctcccaaagtgctgggattacaggcatgagccaccatgcccggccttttttttgttttgttttttttaagacggagacttgctctgttgcccaggctgcagtgcaatggcacaatctcggctcactgcaacttccacctcccaggttcaagcgattctcctgcctcagcctcccaagtagctgggattacaggcgcccgccaccatgcctggctaatttttgtatttcttagtagagatggggtttcaccacattgatcaggctggtctcgaactcctgacctcaggtcatccacccgccttggcctcccaaagtgctgggattatgggcatgagccactgcgcccggcccaaaagattttttatagagatgaggtcttactatattgcccaagatggtcttgaactcctggattcaagcaattctcctgcctcagccttccagagcacctggattataggcatgagccaccatgcccacctggcctagagaactaactagacacttccagaagccaggaataccctatgcttgccttatttacctttgtatttcagatcctacacactggctaacacacaacaagcactcaataaatatgagggtcttagttcaagagcaaggaaagatctgataatgtggcaataacaatacactacattttacagtcagtggcaatttaatgttatttcatttctcaactcatctctgggcaatgagattacagatgttcttttttgtatttttatgcattatctgaattgtttacaaggatgtattttgaaatagaaaataataaacttgactccccattaggaaaaagcaattctcataaccatcattgccagttttttgacaccttttggaaaagggtagggaattaattctgccattgactataattcagcaggagggccaagtgaattccttcatttcataatatttaatcaacaccaacttgtgttaagaatggaactaggtaggcatgaggaatgtatatgtgctccaaataccagcttatggcctaaggagagagacagacattgaacacatactgccactaacaagtgtccaggtgcaactgtggcagctgctatgggaaaggtaatagagcacctgtgaccctgagattggtctcctgcttgggcctaactccatatgtttgctcttacaaatgtgtttccctacccagaaggcccttccttcttcctccatatagtcaaacttgactttgctttggaatcttgcttaaatctctagttcctgttcaaggtctgtctgattggaggcttccttcgggtaatgtcagatagcaccaccaagataatgcaattcgttaggagttatattagccagggtttcccagagaaaaagaaccaacaggatgtgtaaatatagagagagatctattgtaaggacttgactcacaagattatggaggtgcaaatccaaagtctgcaggttaggtgggcaaactagtgatttagggaaggggcaggggcagtctgctgacagaacttcttacctggggaggtttgtctttgttctgttgaagaccttcaactgattggatgaggcacacccatactatggaggtcaatctgctttacttaaagtccacagacctttttcccgcttcataaatctttcattggaatcaaagaccacggatttaaatgtcaatcttgggctgggcacggtggctcatgtctgtaattccagcattttgggaggccaaggcaggtggatggcttgagcccaggagtttgagaccagcctgggccaacatagtaaaactctgtcactacaaaaaaaaaaaaaaaaaaattagccaggcatggtggcgcatgcctgcagtctcagctacttcagaggctgaggtgggaggatcgctcgaacccaggaggcagaggttgcagtgagccaagatcatgccactgcactccagtctggatgacagagcaagaccctgtttcaaaaaaaaaaaaagtcaattaatgccatccagaaaacgtcttcacagaaatatccagtataatgtttgactaaacatctaggtactggggccaactggacacataaaattaactatcacagaagccttaactccccaactagagtctaccattttagaaggcatggatcagctcttccatgtctttgaaagcttccatggagcctagctgagggattattgtcaggaggtgttcaagaaatccctgaagagggctgggcacagtggctcacgcctgtaatcccagcactctgggaggccgaggtaggcggatcatgaggtcagaccagcctgacgaacatggcgaaaccccgtctctactaaaaatacaaaaattagccaggcgtggtggtgcatgcctgtactcccagctacttgggaggctgaggcagaagaattgcttgaactcaggaagcggaggttgcaatgagctgagatcatgccactgcactccagcctgggcaacagagcaagactccttctcgaaaaaaaaaaaaaaaaagaaatctcgaagcatataagaatagaagaatgagatttaacaggctctctggaagcaactttgtgcaccttctggaaacaatagaagacatgtaccggtacctacttaaacctcagagtgcaattcacatggtggcagagatccccaaagcacaaccctgattctttctccatcctgaaaacactgccccacaccttctaagacagtaacggatttagatagaaatgactgtccatttgggttttaacttagcacagccctagccagtgaagaaaagacaaaagaacaaggcagaagaatattgtggccttggaagaaattcctgacactggtctctgaccatcattttatgacatgtgtacctgtttcaatcttcatcttcctctcagcctattaagtcatgcagcgagctcctacctctcacttccttctatccccgaccaagcttaaatcagcctcagaggctggagataaaccaggctcagaggaggggcctggtggtttctcagtcaatttgcattccaagctcaaattttcatttctaaacctacaatttcatttccaggctttcccttggttccagagctggctgctgcttaggcgagagtgggaggggggggcctcagtcagaaatctcaagcaactggaccagaggtagaatgcctcaggccatttttcaatgccagtccccattgttatgggtcccacatcgacctggtgctcttgtttaac

SEQ ID NO: 38 - DNA, 88645 bp, Artificial Sequence
  Synthetic BAC sequence
gcttgtttcctaccttccctccgggtgaaaatgaagatttgagttcctattttctttctttttttttttttttttgagacggagttttgctctcattgcccagggctggagtgcagtggcgtgacattggctcactgcaacctccacctcccaggttcaagcgattctcctgcctcagcctcccgagtagctgagattacaggtgcctaccactacgcttggctaatttttgtatttttagtagagatggggtttcactatgttggccagtatggcctcgaactcctgacctcaggtgatccacctgcctcggcctcccaaactgccgagattacaggtgtgagccaccgcacccacccgatttcctatctttcttgagaagcatcttccaaaacgtaaatgcacagactctcagagctgaaggaagcctcagggtccagctagtccaatccccggtgatgtctgaattccccttacaacatcctggcaggtgaccacccagcctctgctcgaatgcctcttgggagcaggaaccccccttctaccccctgaggctgagcagaccatgtttgatttttttccaagaaaatcttccccaaagggcaccttagccttcccatcccacaaactcaactcccagtggtcagtggtggtgttgggaggtcgaaggaggtggcacagaagtgtccacaccatccctggtgtacagcaggtgcccaaaatgtttaagcagatgaacgttctcgaggaaaatgatttaaacttgatcaaccagttactttcaagaagggagctccatgagtgtggaggcaactgggacacacgctgctcaccgggactgccaacaaaaactgggtgcaggatgtggctctgccggcacctcacacccggggacctgagcaactcactcggcctgtgaccccacctcttcacctggacagtggggctgacggtccctgctctgtgggcccacaggccattttcagttttagtggaaataatgtatatgtgaactggaaaggacttgataaacataagggttattcttattattcttcctattattaaggaataaagaccacagaacagtcccaacgtctccatttataatcttatttatttatttatttatttatttatttatttatttttgagacaaggtctcgctctgttgaccaggctggagtacagtggcgtgatcatggctcactgcagccttgacctcctgggctcaagcaattctcctgcctcagtctcccaaatagctgggactacagacgtatgccaccacaaccagctaatttttgtagagatggcatcttactctattgctaggactggtcccaaattctagggctcaagcaatcctcctgcctcggcctcccaaaatgttgggattgtgggtgtgagccaccgcacctggcctcaatttataattttaataattctccaaggagatattgatttttcatagaaaaagagcccaaactcctcctacctatcaagacttggggaaaatggcctcatttgacatgtgtagggtggagtagggaatacaaattagtatcactccatatccctgaaaaactgcagtaacaccgttaaacccaccctggcagcaagtcgtgccctgaagatgcgttgcttattcctctcccctctcagctgctggaggaacttgagggcagggctgggcttgctcctctctgggtcgggcacagcctggagctcagtgactgtcacacgagaagtcctaggccagcaagtatgggagttggtgaggggcattcagtggccactgaaatgaatctctcattggcggttgagcccttcttttcctgctttttcccattttcttccctgagagtggactctgttgatatgctttggctctgtgtccccacccaaatctcatcccaaattgtagtccccacgtctcaagggagggacctgtaatcctcacgtgtggagggagggaggtgattggatcatgggggtggtttcccccatgctgttctcgggatagtgagtcctcacgacatctgatggttttttaagtgtttggcagttcctccttcacacgctcttctctctctcctgccaccatgtaagatgtgcttgcttcccctttggccatgattgtgcatttcctgaggccttcccagccatgtagtactgggagtcaattaaacatttttcctttataaattacccagtttctggtatttctttatagcagtgtaagaatggactagtacatctgtcaaagaggatttgtcctaacgcatatgaggacattgagtatgagacattttacagttcattggtgtttgccctgaaactccaatggccccttattccccgacaagatttatctggggtgtgcttgatggaaaggttccagggcctgaggctgggggctcctgaccaagaaaggggctttgaggaggacagagcactggactgggagtccaaagacagtcctcattccatcctgtcagcttgggtatccccattccccctcagcctgcttcctatctatgccaggagggctgaccagggctgctcccaaagatctcacccacctctgcggtcattaaactgatggtgaaagtccttgaggtggcctgaggggtaataacttgtaaagtcagacgtccatgggtggaacagagcagagacggccacggaactcggagggtgtaaacagctccaggcacccaagccaagtcaggcactggcagagagtttggcatctattttctaatagctaagggaaataaaaaaaaaaaagcaaaaaaaacttgcggagttatatatttcctgtggaatgaaacattctcaaagatctacttcctggatccgtacttgcccgcctctaacagagccacgaataaggtctctgaccactggagacacgacaatggcactcagccaggtggcctatcagtcgtcacggagaataaaggcactgtctctactcagactgtaggaaggctggcctccagggccctttatgttccttttttttttttttgagatggagtcttgctctgtcacccaggctgcaatgcagtggcgcaaccttggttcactgcaacctctgcctcccgagttcaagtaattctcctgtctcagcctcctaagtagctgggattagaggcgcctgccaccacacctggctaatttttgtatttttagtagagataaggtttcgctatgttggccaggctggtctcaaactcctgacctcaagtgatccacctgccttggcctcccaaagtgttaggattacaggcgtgagccaccgtgcctggccccctttacattctgaagacctaactgaatgcagcccgagagcctgggtgtctatcagtgtttcccaaagcattgttgtgcatggctttgaacacacaaaacatggagtgttcaaaccctgcacattccatagactggtctggcccttgatgggatcctaggagatgacctctaggccctcagaaaatccagcccaatcagactgtctttacatgctgaggcctgggccatgccagatagtttatgcaggcagtgtggtttatggttggagacatgggccatatggtatcagtttaacctctggaggggctagagactgagtcactaagatcagccatatggatgttccacacctatgtgaatgatcctcaatttaaaaaaaaaaaaagccgggcgcaatggctcacgctgtaatcgcagcactttgggaggccaaggtgggcggatcatgaggtcaggagatagaaaccagcctggctaacacggtgaaacactgtctctactaaaaatacaaaaaaaaaattcgttgggcacggtggcaggcatctgtattcccagctactcgggaggctgaggcaggagaattgcttaaacccaggaggtggaggttgccgtgagccaagatcgcaccactgcactccagcctgggcgacagagagagactctgtctcaaaaaaaaaaaaccctggacaccaagacttcgttgcacttccctggttgcttcatgtatgttgcctcccactgctcctgggagaagtaagtgccgttcacatgactccactgggcgaggacaattggaagccgtgcctgtctatgcacctttgctggtttgaatctggatcctttctgagtataactcagagcttttctgagttctgtgagtcctgttagcaaatcagggaacctgagagtggtcttggggacctccccccaactcaatggtctttggataactttgacaacctactctatcagtttttctgagacagagcctggagtgctcattttattaagtttctcagatgtttctgaagcatagcaaagttaagaatcactgcttgagagaaggaagtggtgttttctgtttgtttagttgagacaaatatatgtgtgtttgctttgccttcaattagcttgtaacccttacaaccggaattaccaaacattgcacttgtactgtggtccccaaactgtccatccaggcacccagatgccacagcaaactcacaggcatgccatcgaatattttattttattttattttatttatttggagacagactctcgcactgtcacccaggctagagtgcagtggtgcaatctcggctcactgcaacctcagcctcccaggttcaagagattctcctgcctcagcctcctgagtagctgggactacaggcgccggttaccacgcccagctaatttttgtatttttagtggagacagggtttcaccacattggctaggctggtcttgaactcctgaccttaggtgatccaccctgctaggcctcccaaaatgctgggattacaggcgtgagccagagcgcccaggctgaatattttaaatcttcaatggctagatagcagtcattaacaatgtgtgaaccagctccaggtagttcacagtttcaaagcttggtcatgctaccttccttttgatggaatcatatcttcgcacagctgggttttcggtgattgctgtgataaaaagtaagtaccacacaaaaatcaatgggtacttgtgtgggacaggaaatcagggtggtgatgtcaatctgattccaaggtctgggaagctgcgtgatttccatgagcatacacacctcagtagtgagcagctttggttgttttacactgaaatagaaatgctcttttttctttcaatttatgtatgcattttttcccaatggctgctaatatttattaaattaggacacaaatacttataaagttgtttggacctaatcacttaatatatggaattgttcgattttgtttgatcgaaggacaccatgaaaaaattactgagacactaaggatatcatgaactgaaaaaattcaggaacctttggactaatgggaagggtcagcataagtaatattgtttccttctcagaagtgaaggaaatacaagttaaaggacaccaagaagaaacaataaaacaaatccagaacatgggtcgttttacactaatacttggcctagtgtcttcaaaatggtattgccactacattaaaaatagattgaagattggtctacattgagagatattacaatgccaacttttttttattggatcctggtttttagaagtacatttcaggtcaggtgtggtggttcatgcctgtaatcccagcactttgggaggccaaggtaggctgatcacttgaggtcaagagtttgagaccagcgtggccaacatggtaaaaccccgtctctactaaaaatacaaaaattagctgtgcctggtggcccacgcctgtaatcccagctacttgggaggctgaggcacgagaatcgtttgagcccaagaggtggatgttgcagtgagccgagatcactccactgcactccagcctgggtgacagagcaagactctgtctcaaaataaataaacaaataatttttttaaaaaaggacatttcaaaatgttctatagcttgggaagtttgaatatggagtaggtattagatgatattgggaattattgttcattttattaggtgtactaaatgtccttgttttaggtgaagcattatgtctgattttctttaaaatagtttgccagcaaaacatgagcagagaaatgaatcatggcaaagtgttcattattaagtcaaggtaatgtttttgttatggttgtgtttttacttttcggaatattttgaaattgtcctaatacaaagtttgttaaaagtgatgggttagtggtaaactgagcaaaatgatttgcactgaataggcaggaatataaaaatatggacaactccactgaaactcctcccaactctgccacagaatcggacataggcaaaatggcaccttggctgctgaaggttttgtgaagtagccaatctccctaatgggaaaaatcagaatacaacctcaaaaagctcatgcatggaggaggaggggccaccttcttctcactccacatggctggacgaggagttgaggacagagtgtgtggattatccatctgctgagaactgagacaccagagctgggcgtcaggatgacagcacagtgagaggcccaggaccctcgataccccatccccagcatcaccacagctcctggctcacgtcgaatgttccacctgggtggacttctcaaggagatgcttgctatgatcagaatgtttgtgtcctcacccccaaattcatgttgaaactaaaagccaaagcaaaagtattaagaggtagggcctttgggaggtcatgaggctggagacttcgccagtgaaattcgtgcccttatcaaagaggccccagaaagctgcctcaccccttctaccatgtgaggacacagggagaagacgtccatctgtgaaggaagctggtccttgccagaccctgaatctgccagcaccctggtcatggacttcccagcttccagactgtgagaaatgtctgttgcttctaagccattcagtctaaggtattttgttaccgcagcccaaatagacaaacacagtgttccttaaaaactgccaggcacagcggctcacgcctgtaatcccaacactttgggaggctgaggtgggtggatcacccgaggttaggagttcaagaccagcctggccaacatggtgaaaccccgcctctactaaaaatacaaaaattagctgggcgtggtggcatgtgcctgtagtcccagctactcaggaggctgaggcaggagaatcgcttgaagctgggaggcagaggttgcagtgagccaagatcacaccattgcacttcaacctgggtgacagtgagactctatctcaaaaaacaaaaacaaacaaacaaaaaaacactgcatcccaggctgggtgcagcagctcatgcctctaatcccagccctttgggaggccgaggcggcagatcacttgaggtcaggagttacttgggaggctgaggcaggagaatcacttgaacttgggaggcagaggttgcagtgagccgagatcgggccattgcactctagtctgggcgacagagtgagactctgtctcaaaaaaaacaaaaaacaacaacaaaaaaaactctgcaccccagatgctagaaatattccatagccgaatgcggtggtagttatgagtgtgtagacaaatggagacatccatagagctctccacttaagatttgtgtactttactctttactgaaattaggtacgtcttagtttttttaaaaaaaattccttccaccaaaaaaaaaaaaaaaaaaaaaaagaagaagaaaaaatgcatcccagtgagctggggaggaaagagtgaaattgtagctgcttatctgggaagcttcagaaataaaacattttggaacgaccaccccgaggtagaagacgaggatttggaaatacacttttaaaataaagtgatgggaggctgggtgcagtgcttcacacctgtaatcccatcactttgggaggctgagtcgggtggatcacctgaggtcaggagtttgagaccagcctagccaacaagatgaaaccccatctgtactaaaaatacaaaaattagccaggcatggtggcatgcgcctataatcccagctacttgggaggctgaggcatgagaacccaggagatggaggtcgcagtgagccaagatcatgccactgcactccagcctgggtgacagagcaagactctgtctcaaaaataaaaataaaataaagtggtgggaaagagagacgtttagtatctcagccacactaaacctttaagcctctgtgcacacagccagtcatttcttgatctctttgttaatataactttagtatcaggcagtttgttgtacaaagtcctgcagttcttcaagtaataaactcacatcaaaacactgtttccgagcattaaaaaaatatatagcattgatttaaaaaatgaatgaactgaacaaaggtctcccactaatgaccctcgtgggatatttgagagggttttggagccagcagaggccaaactagagagtggggcggggtgggggcggggacggtagtcaaaaacgtcagcgcaagcccaggaagtacctcgaaacctcatcttcctgcccgaagatgaactgcctgaactgtgcggggcagaaaggatgggagcagctgccccaccttcctgcccagtcccagcctctggggagagggtctccccagggcacccttctgggagagacaaggagaaaagttggtgggaggggacggtctgaccaggatgggtgcccagggccttggagggtcctcccgtgctgcagggacccgcaagaaccccgggagctgcctccctccacagctcaccagctcccccgtgagctcaagccaggaatttcaggcaggctctcgggggtccccagacttccttctactccaaggagcctggggagcccgggacctcccagaaaagcatgtgggcagctctgccctaggagaccatggttcttgtcaagaaaaagtcaccgaagtccaagaggctcctccaaagaatgtctactgaattcccttccccttccttcggacacaaaatgtctggagaggcaacaacctggttccaggttggaaatggagccatattacgctgctggggcacccaccactcagatctccctctcacttctctggcttccccctgcatgtccccttctgggcccaaatcctctcctgagagcccccccacccctggtttcgagcctgcaatcatttgaatgacattcaggtccagctggctgcccgtcgatcacgactcgaacgcggggtaacatcgtgtgcatgtgtgtgcgggggactggggggacagtgaaagagtcccaggcaaggatccaggagtcagacccggccgggatctgctacccttccctgcgcaccttaggcagaccacacgacctatccctggtttggtggcctcataataatcaccaaggtttattaagccgctgtgcgcaaggcactgtgctgcgcacattgcatgtattatctcattggattttatatagtgctagcgtctgaatgtttgtgccgcccccgacccccgccccaaattcacatgttgaaaccgagtccccagtgtgatgatatcaagaggcagggccggctggggcacagtggctcacacctgtaatcccagcactttgggaggccaaggcgggcggatcacttgaggtcaggagttcgagaccaccctggccaacatggcaaaacctcctctctaccaaaaatacaaaaattagccaggcgtggtggcgcatgcctgtaatcccagctactcaggaggctgaggcaggagaatcgcttgaacccaggaggcagaggttgcagtgagcccatatcatgccactgcactccagcttgggtgacagagcgagactccatctcaaaaaaaaaaagaggcagggcctttcgcgggtgattaggtcatgaaggctctgggtcggcacctgaatgaatgggaatcagtgctcagagaccctagggaacttgcttgccctttccagctgagcatgtgcccagcatgtgaggacataaaaggcaccatggatgagaaacaggctctcaccaaacacctcatctgtcagtgtctttaatcttgggcttcccagcctccagaactgtgagcaataaatatctgttgtttttgagttacccaggtattttgttatagcagatgaaacagactaaggcatagggaccaatattatcccatctaataattgagaaaacttgggcttgaaaagatccatgatggcttacgcaagctcacagggctaataagcgacggagctgggatagaatttaggcagttgaacttcatgacatgaacataaccacaattctcatgctaaccaatagtaaaataataataataaacaaataatgaggctaggcgcagtggctcgtgtctgtaatcccagcactttgggaggctgaggtgggtggatcacttgaagtcaggagtttgagaccagcctggccaacatggtgaaacgccatctcttcgaatgctacaaaaattggccgggcgtggtggcgcacacctgtaatcccagctactcgggaggctgaggcaggagaattgcttgaacccagaagcagaggttgcagtgagcgaagagtgcactgctgccctccagtctgggtgacagagcatgactccatctcaaaaataataataatgatgatgatagttgacagaggttcttttagtgctaaggttctggggaaacctgcaaatttagtaaaggtggacccacattttcatgttttcaggtcatgatgagtgacctcgctcctttaggaaaaaagagagaaatattccctttgggaggcacagggacagcctcctgggagatcagagtctcgcctctgcctctgcaatcagccaggatctgtagacacagatatttatgaggcagtctgcggtgctctatttcttcccccattcttatgggggtgagaggggcagaaggagaccaaaagccacatacttgcaaagtcatccttcctctggagaccaagaagcagcagattcttttcctgggaaacaagtctatcaggcagacatctgttactctttgcgatctgtatgccataacagtttaaaaaacagagtttaaatgcttaaagaagaagaaaacagtttgcctgtgttgcaaagcagcatataaacggtgctggaattagcacaagggaaacatttatctttcctagataatctcaaaacaggcctttttttttggattgtatataattatgtttattggcatggaaagatgctcatgatatatcactaaaggaaaaacaaaaaacaaaaaacaaaactggttgcaaacacaaactaggctttttaaagaagcattgactctgcctccctggctggggccggggccctctgtgtatcccatagaggaaagggtagaatgggccaagactggctgggtagtagccttcttcctgggagaacagagacagagtcacattttccagcaggaatgaccaaagatttgcctgagctggataagcccagcctggtgtagtgatggatggtgggctctggggatccaaaagacctgggttccagtcctagccccactatgagtcgtggtgacctagtgcagtttcaatgctgctggagctcacttctccactgacacagtggaagtcacatctcctgcacacaggggaggtgctcatgaaagggtgggcttctctccctccaatctgtgttttttttattgttttttttttttttgagatggagtctcactgtgtctcccaggctggagtgcagtagcacaatcttggctcactgcaacctctgcctgctaggttcaagcaattctcctgcctcagcctcccaagtagctgggattacagacatccaccaccacgcccggctaatttttgtatttttagtagagacggggtttcaccatgttgactaggctggtctagaactcctgacgtcaagtgatctgcccgtctcagtctcctaaaatgctgggattacaggaatgagccactgcgcccggcctccaatctgtgtttttatgacaaaggcatggattggccatgagcaatgggcagccctggggtggcaggctgtgaatgagggggaaggggctgcctcgaggggttcggtcccctcctcaggagctaacacacagcctgagacctgaaggatgagaaggagccggccacaccagggtctggaggaagccactctgcgcattggccgtggcccacgcaaaggctgcgggaagcaacatcctgccttgcttccggtcggcttcaggcctgtgaggctgggaagggccagtcgtggaggatggagggtgaggtgggactgagctacatgtcccgggccttggttatgatctgaattttgatgttgagaacaagaaaaagacacaaaaggggcttaagaagagtgagcagcatgaccaggtttgttcttttaaaaaactggatactaggccagacgcgatggctcacacctgtaatcccggcactctaggaggccaaggctggaggatcgcttagggtgaggagttcaagaccagcctgggcaacatagggagacccccatctatacaaaaaaaaaaaaaaatatatatatatatatatatattatatacacacacacatacacacacacacacacacacacacacacacatatatataacaaattagccaggtgtggtggtgtgtgcctatagcaccagctactcaggaggctgaggtgggaggatcactggagcccaggggtttgaggctgcagtgagctatgatcacaccactgccctccagcctgggcaacagagtgagaccatgtctcttaaaaaaaaaaaaagaaggatactagatgaagatgaggagcaggggtgtggcgtgaggaggacagaccagctaggaggaggagcctctgggcaagagatgaggtgacctggtcagggcccgtggccatggagatggcaggcatggacacggtgaagctatattttggagaagaatctagaggactttctgatgatcagatgtcgaagtgcaggacagaggagactctcaggccacttccagctgcccctacccagtggccttgtgggaatcaggaaaagggctcctctaaacaagcatgcagcacagggcacccgtgcaagaccctcaccctgagaccctcccttgcaagtgcgaagttgctcaagcccctgattctcactcagagacctggtcaattttggacttgcaaagcttgtagtgtctgtggcaatccaaggggagccctgggctctgcccaaggtttagggaccatttcaacacagtgattctacccctggctccagctgtgtgtgaagtttcttccctccctgcctgggcaccagactttttacagtactcactgcattggacgcaactaaccttgtgaagaaaagagtttttaaaaccctggaagctaatgttacaagactatttagcacttaaataaatgcaagttctagaacatctgcagccaaaatgaaagtaaataatgacagaatgtgagtcatgagtagtttgcaaagattgtaaacaaagcatcctcccaaattcagagccatggcctgagagttgggtaccaattaatcagcccttaactctatcacacacaaaaggacacgtgtcctcattagcaagtcatgaggggaacttagctaactgactgtcactttgctatctggagttcacttaaaactgaaataaaaagcttattccctgaagaacagagcactcatgctcacattgtttgaaagaatcacttcactgccagtgtcaacatgaaacttaacatcctgatatttatgggaaaggcaaaacaaccccgctcgtaaactgaagagatgagcccaaccacccaggcatgtcccatcagtccctctcccaggggctggtcactttctttctgatggcagttgttggtgcagacttcatgtcctctcctagccaattgctctccaagggcagggttaatgcctcattctttcatccccctacattcctgtgtctagtatttggcctggatgtaataggtgcacattaaatatctgttgtgtgagtggatgagcatctttcccaaaaggccaatgttcactccagccctggacttcccgaaggccctgtccaggcagaggatggaccaaaaagggagctgggtaggagacagaaggtttggctcctgtcccagactctgccactcacaagcatgtgctcatgtgagccacgtcatccattttggtgttcccatctctaaaacaggaggaatagctgtccccccactttttaagggtttgcgatgacgcgatgggaaagaagcacttggaaaggggttccacaagtgtgatgtggttcccctcacacctcagaggggagttctgcaattgagaaggcggggcagtggaggaccacggttagacatggtgtgcaacttactctcagaaagccagcaggtaagcagagtggatttggaggtataatgaatgactgcaaagtcacagaagacaaggccacccaggctgtgctctctgcacatgggaactagaaatcagagtacaaaatatggagccagcagataacacaaatatgggagtggcctgctgtaaggcaatagggaatggtggggcctgcagccaactagagattacaatcatgctctgcttcaggcatttgcaaaaagatttaaaacttacaccccatgaaacagcaaaacgcatctatggcctgctggctgggagtctgagacccctgcagatggctgtatcaagcatgtctttttttttttcaaatggagtctcgctctgtggcccagactgggtgcagtgccacaatctcagctcactgcaacctctgcctcccaggttccagtgattctcctgcctgaggctccccagtagctgggattacaggtgtgcgccaccacaccggctaatttttgtatttttagtagagacggagtttcaccacgttggccaggctggtctcaaactcctgactttaggtgatccgcccgccccaacctcccaaagtgctgggattacaggcgtgagccaccatgctgggtctctagcacgtctttttattccaatgctcacttggggccttgctgacactggagagactgcccctcccgggcagggccccctaattcctagagatagtaaacaactagggtgtacctttaatatgcaaagcaaccaatccagagcatgtaacccagatgcctccttgatcagactctcacactgggggccatgacccatctgccctaagcacctcacgggctggccagacaactagggacagtccctataccccagagcctgctgaaatgactcaaaccagcccgtccgaagcctgtttaccctgcttgccttttccaaagaaaccacagtagaggctcttgcccacattttccctctgggctgcctcctgaccctggtgcttcccccacgtggccctgcatgactatcgcatgccacctcagcttaggaactgcgagcaacaaactctctccagtggcagttgtctcctgactgttggcctcattaggcctgaatagtaagaaaacctgtattttcatacatctgtaaaccccaccggagcacagatcatcattgctgctttatttccccctgtgaatctcggcacctagcacagtctctggcacgttgaaaacacaatttctttctctttctttcttttttctttctttctttctctctctctctccctctctccccaccccgccccccccgccccctctctctttctttcttttttaagccagagttttgctctgttgcccaggctggagagcagctcactgcaaccttcgcctcccggattcaagcgattctcctgcctctacctcctgagtagctgaattactggcatgcgccatcatgcccagctaatatttgtatttttagtagagacagagtttcaccatgttggccaggctggtctcaagcttctgacctcaggtgatccacctgcctcggcctcccaaagcgctgggattacaggtgtgagccgccacacccagccaaagatacaatttcaacgctaatcgatgaatggatgggcatagggacgaaagcaaagggctgggtagaagcatctgtttggctacgcgggtccctacacttcagcctcacatttgcaattgcttcaggacactaaattctgcatatgcctcatttctgcgactggcatagacgtaggcaatcaggcaggagcaagccagagggagtggcataagttcacgctagtaggagtaaatggtgattaaactctgaggctcaccaccctgctggcattcagctcttcaggcagctcctaagtgggggcgggcggaaggcttttcttttaatgtccgatcttctggctaactctggctatttgctttattcaaactcttaaaaagagatggtcatctcaaagagtctctgcacccattgataaaaggggaaaagtcagagagcagcctcctcgcccaccttcagtctctgggacctgcccacaacaggctcttccaaagggagtcaatcaggtcgccatgaagcctccctacgtctgcaatggtgcagtgggctgtccccacatccctgaataaccgaactgcatccggttaataaaccgaaagctgagctagagaacctgtgttgtttttcatctttactctttaaaatgcatcaatctagccaggcgcggtggctcacacctgtaatcccagcactttggaaggctgaggggggcagatcacttgaaggcaggagttcgagaccagcctggccaacatggtgaaaacccgactctactaaaaatgcaaaaattagctgggcatgatagtgggtgcctgtaattccagctacttgggaggctgaggcacaagaatcgcttgaacctgggaggcggaggttgcagtgacctgagatcatgccactgcactccagcctgggagacagagtgagactccatctcaaaaaataaaaaataggcctggcgcggtggctcatgcctgtaatcccagcactttgggaggccgaggcaggaggatcacgaggtcaggaatttgagactagcctgaccaacatggtcaaaccccgtctctactaaaaatacaaaaattagccaggcatggtggtgcatgcctgtaatcccagctaatcaggaggctgaggcagaagaatcgctttaacccatgaggcataggttgcagtgagccaagatcatgccactgcactccagcctgggcaacagagcgacactctgtctcaaaaataaataataaatgcaccaatctgctctgcttgacaatgaactgaatttctctgatcacggggcccttgtgtgtcattctcagcataaccgtctccttcctaagttctggaaataggcagagagaagacaggcgcagagtaggcctgtctgggaagtacctgaggagggtggagaagcctgtgtttgctgtttctgatgaatgttgttgggttatttagtgcttggcagtgaacggttccctgaagaccatccctttcccaggccctggatggaagggcaggaaacatttgaccacagtgtctagacagcgaggctagggaatctggggggctgcccaggagctcatatgggggacagccatcagtagggtaactgacccagactagaaccagattagggcttgtaataggcattatcctagtctaattattgagatcaccccctcttttctcccaaaagtgtcctagtttgattgataaattatacagccaccttcaacattagtgaattttgcaaacaggaaagtctgagttgggaggctcacacgcaacagaagctggtcactttgtacaaatagaaagggcttagcaaacatcctggaaaaggcctggtggcagcacccaaccccctacaaatagcaggaacaattcaccaaagggaactgagcctgaccttggccctggtgggctctgctctaaaagtggagttcctgggctggcggggacagcctggcccaagcgtgccccgcctggcccaagcgtgccccattcacagcctcctcacccaagaagggcaggcttcaaggcagcatttcttttccccgttgaagtctcaagccagagttagcaagttcagcaaagggcaggagcagagaggaaaggattatgatgtgtccccgatgggtacaggagaagggaacagccccaccaactccaacctcagtacgcacctgtgctacaatcccattcaacaacaccttgagttgccatggggaccctgaacaatttcccacttgtgttttttttccttcctggttgagatcttgtttctgtcaagatgaactatttatctgtgttgcatgaaatgtcatgggttgtggtcaaaaccaggaccaacccacgcacaagaaataataaccctttgatgacactcacacacaagcttcccaagtctttagaggctgtcagtgattcattttctttttccagcactgaacttgctctcgagaaatatttaacccaaaaggcgactggcaggccatacccccagtagcctgggtttgccggatcaactcatgtttgagttaatttaccaagtgacctgtggacatgcgtccactcaccagagaggcagagcaaacacttacaaggtaaaaggtagtgtgatacgtttcaccttgtggccttacatgaggtttaattaagctacaaaatgctcgacgtgtccagtgttgaaggaatctctgttttgtaaactaaaacttccaagttattattattctttttttatgttagcttagccatcatgcaaaatttactggtgaagcagttaataaaacacacatcccattgaagggttttgtacatttcagtccttacaaataacaaagcaatgataaacccggcacggtcctgagaggaaattcctttgcttcttaaagctgccagtcccggctttttgggggctcatgtgttataaattctggaagctcttttagctgcagtttgagcatcaggcaaatcttcttcctcttcctcggttcgcttgtgttttaaaaacaagtcagactttaagaagcggctgtagctgtcgtacttcatgagattaaagatctaaggaggaaaagaaaaaagagtctgaaggctgaggctaatccaggccataaatcatcccatcagatatgtattaatacctaccatgtgccaaagaatactaacatgtgcaaagaacacactaagaaagctcaaataagtcatctgctagacaaggcagatttcctggagatttttggtcattatgcaataatctcaatggaatatatagacagtcacatgaacaaatatgcctttattttccacggaaatatagattcacacagcactgattcagacccttgtaccaagaagtccttcaagactctccactttatttgcctagataagacaaggatgtatttctccaagagcttgagacagccgaatagaaaccatttctgtagagacagtggtgttaaaaagatcactgacatatcatatgatgccagcattgttaagactcccagtaagtctggcatccgagatctcaaacaaacctattattgtaccaggagtcaaaatgaggcgtgctcactgcagggcagggcagcaaaactataatcttagcaagggaacaggtcccaaataaagaatagagcagccagctgcagaatgccaacatctgtgccatcagacaggctggggagcacatccctagaatgaaacaactctaaggtatgtcaggtgagcgaagaggacacccgacagagctgaagtgccccagattagacggctgcccccgccggcatggcaggtgctcagagggctgtccccaggcacagtagcttcctctggccgccactgaacctcttttctgggccacagtccttgtgaccagcattcattctcccccactgctacccaatcctgtgccatctgccctcctcccttgccccaggaaaggggcagagaaagagaagcacaaagccttttccagctgtcaagggctatgatctctttcccacccctcatttctctctctctcagacctttccacttaactcgcagtacactctgcaactaaaaatccacatggttcaccctggtacacggaacaaccaagtggaaagttccagagatgtctagaatgtcactgactgccaggcggggttgtcaagtggatggtaaaaccctgacatcttttaaggctgccctctcccaacacacatacactattttgtaaattaaacatctgagggtgctgggggcggtggctcacacctgtaatcccagcactttgggaggtggaggcaggtggatcacttgaggtcaggagttcaagaccagcctggccaatatggtgaaaccccgtctctactaaaaatacaaaaattagccgagcgtggtggcacacacctgtagtcccagctattcaggaggctgaggccaaagaatcacttgaacccaggaggcaaaggctgcagtgagctgagatcacaccactgcactccagcctgggcaacagagtgagactctgtctcaaaaaaaaagaaataaaataaaaattaaaaataaaacaaacatctgagggactcaaaggactcagaacatctgcttggaggatgggaggtgcttcaggagggaactggaaccctcaaattttacaccttcatcttcccaagatggcttcaaccacagcagaactgcctgagtcactgtgctataaacagagtccacaacccagagaaagacctgggactttaggttttctttaaactgttaaactagcgcctgcccatcccctggtgcccttctagtcttgcccgagtcctccagctgctcagcaagaccctgcctccttaagcccctgtcctgtgccacactagagcagtcatctatcttgtagccatcctgtaattccaggtgtgattgtaatttgctgaggtttacagaaaaaaaaaacaaacttttttttaatcccagaaaatacaaaaatcatagccagggctgaggtgggggatgagaaacgccattactccttcatggcctcccaccgacgtgctaagcaagcgtcaccatctgccttattcagcccttccaggcacaagagtccccaaggggaaactttcagaggctcacctagttcaaagtctgcaatgaacgctcaaatgtgactaatgaaaccagttgcacgaaggtcccacctggcacccagcctcagtcctgtacccactcccaccccaggtccacgcagatgggacccaccactctaagcaggatgcggtgcgacccaagcgtctcgtgtgaagtctgcatgtgggagaggaacatcctgtttgcctgtagtggctctgaggctcagacttcaaagtagagaagaaaaaaggccggtgctgggggcacccagggcagaggaggagggggagggaaggaggctgcttcggctgggaggaagctcaggggctgcaccgggctggcaggactcgaccccgagatcccgagatcccaaggctgccagcaagcctgaggggagggggctgcgaactatttattaagagcataagggccactccctactggggcaggtgtgaaatgccccacgagtgcagaagtccctcaggcagaggtttcctcctctgagagcccttgcccatctcccgtgctgctgcagtgactgggaggcagctgtggctgttggacccagacaggctggagaaaggagaggatgtcgcccccaaagccctcgtgcgcctgggctgtgggaagcctgattgctttacatggggtgcacgggcagacttctgactgccaccggccaacgaccccctgggcctggctcaggagcacacagcaacagggtgctcctgggacggggctcagcaaaggtgacttagaggatggagaatgcaactaaggccgggtgcggtggctcatgcctgaaactccagcactttgggaggctgaggcgggcggatagcaaaatcctgtctctactaaaaatataaaaattagcagggcttggtggcacccacctgtagtcccagctactaaggaggctgaggtgggaggatcacctaagcccgcggaggttgaggctgcagtgagctaagatcacgccactgcactccatcctgggtgatagagccagaccctgtctcaaaaaaaaaaaaaaaagagaatgcacctaaaactttcttccaagaaagtggccagagatcgtgtgcccagctactggccagagcctcatctatcacagggaaaagagctgtgactggggcccagtaagtgtttaccagtggctgaagagaaatcgtgcgctgtgcagcagcagaggctggggaaatgaacccggctagtaccaacgcggctgcagtgccctccagccctgcgctgggcagcgtgtgggcattctttcattcagttctccctccagcgctctgaagacccccatttgacagaggaagaaacgaggggcttaggggttcctcacagttctggaggctagaagtccaagtcaaggtgccatcagggttggtttctcctgaggccgctgtcctcggctcgtagaccacaccttctccctgcgtcttcacagggtctccccggtgcacgtgtgtccttacctcctcttctcacaaggacactagtcagattgggttagagctcacctcaatgtccttgtttaatgttaattacccctttaaagccctatctccaaataaagtcacattctggggattaggacttcaacatatggattagggaggggagcacagttcagcccataacagtgagcaaaagagaagggcggaaggccagccctggcaggctctgcagcccccactcccaaccatgaggccatctgccactcgcatggcaggacaataaaaacgagggctgcaaagagagtaacatggaaaactgcccgtgaatgttaaatgactgatactaaattttaaaaacacaccctatctaaaaacaatgatcccaaatacgttcttttttgttgttgttgtttgcttttttgagatggagtcccactctgtcacccaggctggagtgcagtggcacgatcttggctcactgcaaactccgcctcctgggttcaagcgattctcctgcttctgcctcctgagtagctgtgattacaggtgtgcgccaccacacccagctaagtagagacggggtttcaccacattgaccaggctggtctcaaactcctgacctcaggtgatccaccctcctaggcctcccaaagtgccgggattacaggcatgagccaccacgcccggctccaaatacattctttaagagtgtatccatgtgtctaagtgagaaacaatatgtccccaaaggtcagtagtggggtgaatggtgttcccccaaacttacattcacctcgaatctcagaatggacctcatttgaaaagagggttgcataagggtctcaaaataaaatcatactgcatttagggtaggccctaaatccagggactgggtgtccttatcagaagaggaggggacacactgagggaagaaggcgtgtgaaggcagagggagacatcggtgatgcagccacgtgccaaggagcgctaaggagtgccggcagccaccagcagtctgtaagctgaaggggcaagtaagcaccccccacaccctctcgccaccacccaccagagtcttgtggagaacagggccctgccaacaccttgatgtcatattttcaatccgtttctgctgagcgaatacgtttctgctgtttgaagccacttgacttggggtcattgcttatgacagtccaaggaggctcatccagttggcttgttgatttcacctcaccccggctcaaacacagaaaatgagatgggcctaggggtcccagacagttccaacaagcagggatccctgagggggagacatgacctcaccaggtttggactgtgatgggcacctgaacaacacggtcagactccttaagggtccacaaggcagagaaagaagaaaatggagctatctgggctaagcaggaggccgcaggtgagtggaagacacgggaacagagctgaggccaccatccgtccaacaaacggctgctggtgaagcggaaaactcaagttggcggctgagctgcattctgcatctttttttttttttttttttttttttggccaagacagctgcggcttagcaagctttggggttttggcagccccacatctgcaagctgcacgcctggactgtaaactgtttagcatcgttgccttgggatccaatcctacaggctgctggaagtgagactcggacaaaaatgaggagggaggcttcctgcagatgtgcaactctgcacaaccgtcctgcagaacaaggtctttatatcaccaagccacctcctctccagatcccagacattgccatggctgagcaggatttgccttcctgaaagaaaaatatccatgcagtgccccaacttcagactgttccaaatgtgccgctccaggaaaggacgtccccctgacgcatactcatctgtgcagaaacgaggacctcaaccagccttgaaggcccctctgtgaatattgcgtcactgtctccattcattgcgtttcaagcctaataaatattttaacacttctcagaagacaagtacagaagacctaaacaaaacatgcatcctctcttctcttcaaaaccctctgccattttattttaatccagcacaggaggaaaaaaatcattccttaaggcaatgaaagtttaattagcgggatatcatatctgctttaagaacttggtttcgcttgtatatgaaaatcgctgaaagaaggtggaagcaccgccgtctctgaattgcggctctagaatgcgtcctctcttcacacacatggactacagacgtgcttttgtacccacgcgaggagacagaaagggggaagaaaggaagctcctgtccctccagccctcagaagtggctgggcattgacgaggctgtcggggcaaggcgcaaacagggatgtgcctaccccctaaagtgaagaccacctccctctcaagtgggaacgggctgcacccaggaggaggtctgagggcagctggcagacagcagatgagcagacgaagcagctcaagtcagcccttgccccagagcgccaggacgggccacacagaaggctctgtcgccttgcacggctctccagcttcacgacagaccagccagagatggacagtgtgccaggggtgggattggaactccagaaggagtctggacaccagcgggatcagagagacctcgcttggacgatatcccctcccaagctcacgggttcacgcgtgtggcggtcacacgtgtggagcggattgtccgcttttttctaccgtccacacgattcaaattccaggcccaaatgacatgactcactttctgctgggggtgaaggcattttaattttgccttttgccatcggaaggggagttgaatgctcctctgagtgccactctcccctcctcttcccccaaatacttttatttatttattttttttgagacggagtctcactctgtcgccaggctggagtgcagcggcgcgatctcagctcaccgcaacctccaactccctgattcaagcaactctcctgcctcagcctcccaagtagctggaattacaggcacgtgccaccacacccagctaatttttgtatttttagtagagacggggtttcaccatgttagccaggctggtctcaatctcttgactttgtcatcctcccgcctcagccacccaaagtgctgggattacaggcgtgagccaccatgcccagcaccaaataccattttaaagttgcaagaaacatctcaaagtatctcgaatactgcccttcccatcctgaccctcgtgaggcagatggctacggtgtacacagacagccaacctcccttctgtttgaacaaaaaaccacacctgccctttctagcggagcatgctggaaaatacccatttcttccctgcatttgatcttttggagcaaatgtcacctggcacccataagactgacacatcctaagtccctggctctggccaccaccacagcctctgccaccacccaggagaggggaccatggtcatgcaggggcactcaggccaaggtcctgtttggagaaataatggggcaagggagagaatgggcccccaaatgactgccacaggccggacagcccctctctcaccctccgaggccctcaatagctggcccacccctcttacttacgttgaaaaaggaagcatttttcccctcttacgttctgggaaaactcaaagaaactgcattgctaaaaagggaccccattcatggctcctttctctgtcaaggatgtggctgggagcactagcatctcacccaaggctttttttttttttttttttttttgagacagagtctcactctgttgcccaggctggagtgctgtggcatgatctcagctcagtgcaacctctcccttccaggttcaattgattctcccgacccagactcccaagtagctgggattataggcacatgcaaccatgtccggctactttttgtatttttagtagagacggggtttcaccacgttggccaggctggtctcaaactcctgacctcaggtgatccgcccacctcagcctcccaaactgctggttttccattttttttgtaagcaccagaggctgaggacttctttttgagtggagaaggccacctcatctctgcttttccaggctagagtttagcaccagatccaaagcctcgggaaggcaccctagcagacgcaaactctgcttgtgtatttatttattttgagacagagtttcgctcttgtcacctaggctggagtgcaatggcacgatctcggctcactgcaacctccacctcccgggttcaagcgattttcctgcctcagcctcctgagtagctgagaatacaggcgtgcaccaccatgtccggctaatttttttgtattattcgtagagacgaagtttcaccatgttggccaggctagtctcgaactcctgaactcagctaatccacccgcctcggcctcccaaagtgctgggattataggcatgagccactgtgcccggcccaaaatctgcttttaagtgtaggcatggggacccctgatattcatggaagaagaatgagcaccccacaaccccaaacccatgcccttctcttccatggactgagaaagccacgaagctgccatgtgcaatgatctggacctttctatcttcatcaagctcatggctgttccagaccatgctgcgctgtatatagaacttaaaccaaaggcttctgagcaagaaaggtgtgtaaactggggctaagaaatgtgccagaggagaattttgttttaaatctttcatatggaacaactttaagtcactgagcagacttcaatgtgttccattcttcaatgtttgagtacagcctgaaaggaccaataacgtcatcgatttcctgctaagaagagagaaggagcggcaggactgggggatcttaacttttcacttcatacccacctggacacatgaattttcttttctttatcttaacaataagcatgtactaattcaataacttaagataattttaggccagacactgtggctcacacctgtaatcacagcagcactttaggaagccaaggctggaggattgcttgagcccaggagttcaagaccggcctgggcaacatagtaagaccccatccctagaaaaatatattttaaaaattagccaagtgtggtggcacatgcctatagtcccagctactcagcagtctaaggttagaggatggatcgagcctgggaggtcaaggctacagtgagccatgatggtgccactgtattccagcctcgatgacagagggagacccagtataaaaaaaattaaaataggcagggcgcagtggttcatgcctgtaatcccagcactttgggaggctgaggtgggcagatcacttgaggtcaggagttcataaataccttattattataacctccacttcacaaatgagaaaagctaggcacggagagggagcaagtcttgtccacaatctcacagtaactaaattctaaagtgaaagaaggccgggcacagtggcttatgcctccaatcccaacactttgggaggtcaagatgggaggattgcttgaggccaggagtttgagaccagcctgggcaacatagtgagaccccatctttacaaaaaattaaaaaaaaaaatctgagcatgttgacgctcgcctgtagtatcagctacttgggaggctgaggtgggaggattgcttgagcccaggaggtcaaggctacagtgagccaagatcacaccactgtactccagcctgggtgacagagtgagaccctgcctcaaaaatatatatataaataaagtcaaagaagttggggtaggggcagcagggggagtcagatctaaggaaataaggctgtagttatcagtgactttttaacaccagggcattgaacgctcatagactgcttggcagcgcagctcagagaggtagcagagtatttgcccaaagccccatgttacagatggggactcagaagccacagtaagaaacagaaccctcctggggtcagacagcggcagggctggactagaatcccccacttctgcctctggtgctcagggccaagctcatgcatgcactgtgataacagtgatgaatctggcatctccatatccagggagtgatgggcagggggagagggggaaggggggagaggggaggggcagagctcaggccactcccactcaccatacaaatggtgagccacagtcaggaggtcagggtttcacggctgactttctaataacggagctggctctgcaccaagccatccgccttctcttgcccaactggtatgggacgggcacagccctgaactagggacctgagccaaggggctcaggctgtaagaggtccaagccttaccagcccaaccagcacattctataaacagccactgttcacatccctgcaattaaactgtctaccacagcctcggggcctgacccagccagtccctcccaactgaactttcaccaccccctcatgtgctacattcctacaatgctgaccccctaacgcacctgctgcccctgcctcggggcctttgcgctcacctctccttggaaggtcccggctcccaggtcctctcatccagatcccgcttgccattcagatcccagtcacctctccagggagccctccttgagcacagaccctagcaggcctcttccagtacctctcagctcatcccctgttgcatttccttcttagcattgatctttctctgccctccgtgtgggggcagatgctgatttccctgttgtacacacagttcctagcacagtccctggtacagagtagggcctcagttcataattgcagcataaaggaatgaataaaacaacaaatccacaaaccagcagaccaacaaggactgaatcaaaactcctaggaatagatatttttgtttatttgttttttgagatggagtctcgctctgttacccaggctagagttgaatggtgcaatctcggctcactgcaacctctgcctcctgggttcacgccattctcctgcctcagcctcccgagtagctgggactacaggcgcccaccaccacacttggctaattttttgtatttttagtagagacggagtttcaccgtgttagctaggatggtctcgatctcctgaccttgtgatctgcccgcctcggcctcccaaagtgctgggattacaggtgtgagccaccacgcccggccgtaatacatgtttttaaagaagaaaagacactgtaaggaactgcaattccctgaagaaaccacctctttgtaaggtaacccccttccttcctgcttcctccaacttaaatttgtccaacggcagcctttgactctaggctaacgtactagggaaatgcccacagcaccacctttcgcctctcctggctttgcctccaaagggctgggcacaccaagcttgcagaactgaattaaatcagagaaccatctcgccacttacatgaatttcccaggtagcaaagctttaagcccctcaagcttctcttaggatgcctttggctggacacagtagtagctcacacctgtaatcccagtactttgggaggccgaggtgggtggatcacttgaggccaggagtttgagaccaacctggacaacatggagaaatgccatctctactaaaaatacaaaaattagcctagcctggtgacatacgcctgtaatcccagctactcaggaggctgaggtaggagaatcgcttgaatccaggaggcagaggctgcagtgagcagagatggcaccattgtactccagcctgggtgacagaacaggactgtctccaaaaaaaatgtttttgatgaagtgctcattaaaatgaataatgcactcttcacataatacgccgacctcaatttcacttctacttgatggtttggggtcaccaggctcacttatcatgtcactgtcccacagcacagggatgcccatggtgcggcgtgtggcaatggaggtccccacgcccaggctcaggcctcggtgctgtgcttgtactcagtgtcatttctgtgtcctccctagctgtcagtgatcacctcttgctgctcatcactccatagtctctaccacaacttcaaatctgctatgaatggaaaaacctgttagaactgtgtgcaaaccaagaataaacaggacctgactgaaaactcttgaagctctcctttaaacagggtgcatgggagttggctcatctagcctggggctcagggaagattttcccgttcttctaggttccagcggtgccctacaaagtcagagctgccctactagaagctcagagagcagcggagccgcacgtggtgatgaggggctaagttcgggggcggcggtgctgaacacaggaaagcggctgctctgcggctccaccatgaagcccagcagtgctcagcaaagccaaagccgcgggagaggcttttgaaagttccgtgaaatcttgtggctccaaacatgttcccctcagcttcaatctccttcacttaggaaaacagagctctcgagggagcctttgcaagaaaaaaaccggggctaatgctgagcacgcattttgacagttacagcaaggccccggagagacagagttttcaaagcaaaacggaacacaggggcccttcacatggagactcactgtgaaatcggctctgattccaaataccttgttttcacccaattatgccttaggaagaaagttcgtggatctttctctctatgcaattaaaaaaaatttttttttttgaggtggagtctcactctgtcgctcaggctggagtgcagtggcactatctcggctcagtgcagcctcagcctcccaggcttaagcagttctcctgcctcagcctcccgagtaactgggattataggcgcccaccaccacgcctggctaatttttgtatttttagcagagatggggtttcgctatcttggccaggctgctctggaactcctgacctcaggtgatccacacgccttggcctcccaaagtgctgggtttacaggcgtgagcgactgagcccagccttccaataatagatttttaacaacagagtataacagtacttgctttacattcagcagtttggactgcacatctgtttggtgtgcataaacatatacattattattacacttattaggccacatctgttaggggcatgtgcatatgtgtatttatagaaaaaaagatggaaagtctacagataaaatactatttggtggttatctccaagtgtgcaattatgcaataaagaaatgatttcttctttatatttttgtttcccaagtttcttttgctgagcatgtgtgatgcttacagttggataaaaactattttaaaaaatttttctgaggctgggcctggtggctcttgcctgtaatcccaacactttgggagtccaaggctggagaattgcctgagctcaggagttcaagaatagcctgggcaacatagcgaaagttcatctctacaaaaaaaatacaaaaattagctgggcatggtggcacacacctgtagtctcagctacttgggaggttgaggtgggaggatcacttgagcccgggaggccaaggctgcactgagccgggttcatgccactgtgctccaaccagggcaacagagggacatcctgtcgcaaaaataaaataaaataaataaataaataaaattctttgtcattaaaaaagaaaaaaaaaacaatcagcctctgtcccctgtgtttcttcctttctgtgctggctaagcctcccactgaatgagtctaaggggcacgcctactcataaggtccagctccgttctgagctgttgggcaggcgggctggatctctcagagcctgcagtgctaccgcatggagtcagaactctcccattcctcatcctaccttggctcccgcagtcctgggaagtgggatgacctgcattcacaaagcctttccaatccctctgctccaggggcctcaccgagctttgagaaacagcaagaggctgcccaggagcctggcagagcaacacaggccatgatggtcatggggggagcatggtctttgaaggcagatggacaagagggaatctggcttccagcacttttgctccctgcatgacttaatgctaaaaaaaacacttaatctctctgaaccttgcttttctcatcagcaaaatgggaataataacactcattggagataaaatgagacaatacacaccaagtgtgacatcaggctcaaacgggcagtcctaaatggtagttagggccaggcgtggtggctcacgcctgtaatcccagcactctgggaggccgacgcgggcggatcagttgaggccaggagttcgggaccagcctagtcaacatggtaaaaccccgtctctactaaaaatacaaaaaattagccgggcgtggtggtgtaggcctgtaatcccagctggtagggaggctgaggcaggagaatcgctttaactcaggaggcagaggtggcagtgagccgagatcgagccactgcactccagcctgggcaacagagtgagacttcgtttcaaagaaaaaaacctgaaaaggccaggtgcagtggctcacgcctgtaatcacagtactttgggaggccaaggagggtggatcacttgaggtcaggagttcgagactagcctagtcaacatggtgaaaccctgtctctactaaaaatacaaaaattaactgtgtgtggtggtgggcgcctgtaattccagctactcaggaggctgaggcatgagaatcgcttgaacctgggaggcggaggttgcagtgaaccaagatcaagccactgcactccatcctgggagacagagtaagactcggtattaaaaaaaaaaaaaaaaaagaacaaaaacacagaaccaaaagcgaaatggtagttagtgttgtcattactgagaatacctagagcacagaggtcagtacaggttcgcaaccctggctgcactttcaagtgccctagggagctctgacaagattctgaggtccagggtggggtcgatatcctcatatggctacagtcacaaaaactgccttttcaccatacattccactccctttcccagcgcaaatcaatgcccatgcgtccttccgactggctcaaattcaccacttccaggaggccctccgcaagtctccttcaatagccaaatgtgaatcagaattcacatggaatatgctgcccaatgctaaccttttcattatgcctcaggggctacatgatgaactattaatagcttacagcattaggccaccagaagtatgtggaggtgtctggatatttgcacagaaacagcctgccactttgagttctcctgcttgctttctggagttttccgtctattcttaccttcagcaattataggttgctttctcagtacaggctcctcaaatagctccagcctcccctctaatctggactgagaaggcagataaactggtctaaactgtgtgtagaccaagattaaacaggcctggggggactcctgtggggcaaatctcaagcttagaattctggtccccactctccccaaccatggcccctcagtgtacctcggtctgcccggccgtatgagatggtttccagggagtctaacatcgggtgtttcagtaaattcttccaggcctggaattaatgtaggttttcaaatcaaggtgcaggcagggaagtcgggttacctggtcctggagtttctggaacatcagagggtgcggttcttccaggatcttctcgttgagccgagactgcccctccacgttgacctgtgatgaggccttgctggacagaaaggtcatgtagatctcctttgccttttcctgcatctggaggagacagatggggccttgtgctatctgcacacacagccttcccggcctgagccctgctctcccctccagccaggcccacaggagctgctgtggcaagagaaaggcaccccccacagcccaggggctctcaggccactccagagagaatttctatatgggagagcctgcactgccaagcccctacccccgccccttcatgcgcctgcagccacttctcctggaacaaaattgctgcattaaccattcagaagtgatgacagaaagaatcctggcccgcagagagcactcagtaccatttacagccatcctgtggccgggcacagtggctcatgcctgtaatcccagcactttgggaagccgaggcagattgatcacctgaggtcaggagttcgagagcagcctggccaacatggtgaaaccccatctctagtaaaaagacaaaaattagccaggcgtggtggtgcaaacctgtaatctcagctactcaggaggctgaggcaggagaattgcttgaacccaggaaagagaggttgcagtgagctgagattgcaccactgaactccagcctgggtgacagagtgagactgtctctcaaaaaaaaaaaaaaaaatcaagttaaagtatgcacacctactatccctaccagttattaagcgcccactgggctgcaggcacctgcttggagggatcccatttccttaatcccctggacatgcagcaaagggcattttcctgttagccccactttccccatgaggacacagaggtcaggagaggtggcatggcttatctgagagcttccgggagccttaggactgtttggctccaaggcctctgaattctgctcagttccacttccgcaagacacattggcccctccaggttgtgcggtatgcggccttcccaggcagggtgcatttccttttagctaacgagatactgagcacagcagtggagaaaacactcgctgcccgccctcaagtcccgagtgcagtcctgctgggaagcaggagccgtgagtaggtaccggcttcctgtttcacccgaaactaaccgaggctggctcaggagcactcactgatggtaaggagatgacttcacagtgagaactgtgtcttcaggacaggcgcctcagggcggggctgcaggcgcaggagccctctcctccagaacttcccctgagggctcgattttcttttagagaaaggagacttcctgtgctcatacctcgccaacagcaaaagcggggctgtttctctgaacgttagagtctaaagcatgaccttaccctacagagcaaggcagacaacaaatgcctctaaaatgcagccacacagctatgacatgtgtgtggggggcctggaaaactgcctttctctccaagagcccaactggggctccgcatgtgctgtggggcttggtttgggaaatcccaagctctgcaaaccttctgcccttaaggaaaccaccagaaggttttgatagctggggcatgaaaggaaggaagggtagcccttttttagttcagggcactggggacaaaagatcctgagaagccacggcctggccatgtcctgttctgcgagaaagcaagcctcaccagcacttgcagggagacggcccaggttgggtgaacaccgaaagccatgctgtccaccctgtcttcactgtcaataggagcaatgaatcgatgccagactcagtgacacaggagtctctccagacaagcgtggctatctaagggacaggtctgggggccatcctcgagacccaagggggtggcacttaggagctggccctgctgtcctctccaagacccaccagctccatgaagccacagcctccctccaccacccccattccgtcaggaagcaacccttttggaaaaccacttcctgttttaaagccacttcatgaaaggagaatttcggccaggcagatgagcaaactccatgcagaggtctgggggcagaaatcactttagacctcccctcctccccttgacattcacacgcacacacacacgcacacacgtgcacacacgcacacacatacacacatgaatccaggatatcttgagtgattctgaaatagagaagtgcaatgaatggcttgagtctttgaggtggggcagaagaggccgggggagaggaagtaggttccagtgactgcaggtatataagctttgagggtctcagccctgccctcttccaccggctgtccctcctgagtctgcgtgagaacaatgtggggttcaaggccctggctgaccagatgcccactgtgagcagctgcagggctcagcttatctcggcggagctaggaagtatgactgaaaagggaaaccctgagacggcgaccacaagccagtcacgggaaggcctggtgtctaggccgagaacatgagcagaaaagaagaaacagtctgtggagctattttgatagatttttccagagctttgttaaccctattctagctactgtccgggtaggaacagagctggtggagttgattctgtgtctgtggcctggaaggatggccgacttctcttccacggccctgacacatgtggctggccacagcctggaccagagagcccctttctccctggggagacctgaagtgtccagcatctgaggctgtcctggcaggtgctggagagggccccaccttggcccatcaactcggggactgcccaggaagcacctgcaccccagtgagcaccttccaggcaccccacaaggctgaggcccttcttcgaggcccagcagtggctcaactgtgacaatgctcagccagacgtcagctctcgaacccggctccctgcaggtgcacgatcaggagaagcaaattcactttcctatcagccccagaagtgcacctctatgcagacgaacagcaaagtcaccaggggcccaaagctcagaagagcgctgcttcccacactggccccgccctccccaatcgaaccttcccactggaaaataaaagatcccccttgaccccacagctctctacatgggggttaatggcctcaccacccccaatccctctttttttttttcaagatggagtctcactgtcgcccaggctggagtgcagtggcgcgatctcggctcactgcaagctctgcctcccgggttcaagcaattctcctgcttcaacctcccaagtagctgggattacaggagtccgccaccacgcccggctaattttttgtatttttagtagagacggggtttcaccatgttggccaggctgctctcgaactcccagcctcaagtgatccacctgcctcagcctcccaaagtgctaggattacaggcgtgagccaccgtgcctagtctccaattcctttttgaaatctcttaaaagaaaagcatgcacccctgcctccattgtccctcccattcattcctcacgctacacacaggcttccgcccagccagcgctgctccaccagccggctgacgctgcccaggcagcgaggcctctcagaccttcctctggagtgagctggccccagccctgctcagcattgcgactttcttctcttcccgcttccctcaccttgtaagagccctgtcctctcaggatccccaacacctccctgtgtctgtcccccagctcctgtctccctgtgtctgtcccccagctcctgtctccctgtctgtccccagctcctgtctccctgtatctgtcccccagctcctgtctccctgtatctgtcccccagctcctgtctccctgtgtctgtctcccagcttctgtctccctgtctgtcccccagctcctgtctccctgtatctgtcccccagctcctgtctccctgtctcccagctcctgtctccctgtctgtcccccagctcctgtctccctgtctgtcccccagctcctgtctccctgtgtctgtctcccagcttctgtctccctatctgtcccccagctcctgtctccctgtatctgtctcccagctcctgtctccctgtctgtctcccagctcctgtctccctgtctgccccccagctcctgtctccctgtgtctgtcccccagctcctgtctccctgtctgtcccccagctcctgtctccctgtgtctgtctcccagcttctgtctccctgtctgtcccccagctcctgtctccctgtcccctccgtgaattctggggtttcccagacttctgtccttggtgacaactctaactccatgtcccccccagatttcagaccaaccctcccccaagctactgacccatgtagccagttggtttctagcaatgtgggcatggacatcccactgacaccttgaattaacacaaaggaacagagtggtccccttctggctggcaggccctgtagcccctactctgggaagctggaaacttcgatcccctgtagccactccccacccccatcccgtctgctggcctccggctcctctccaccccgtcttcttccagagatggaatgtgggagacaattcctaggacaatgaaaggatcaagacactaactttactaacatcaatttcagaaagagaatgaggcaaagaaaatatccaataaatgatatgagaatattttcaagaactggctcaggaaatgagaagcagtcggagacacagcagatgactctgcagagacccagaagaatgaagccaagcccctgaacaggtggggagggggtgccaacgagaagcgcgtccggagacggcaggagctcgagggcatcaggtagcccagacggaattgatgagggcggcagaaagaagccatcagacccccaggtcctccaccccaggtcctgctccaaacttgagcagtcaggtggctcccccgccaccttcaacagaagagttgagttttcttatctaaagaaacagacccagggaggctccggaacagagaggcacagaggacggcaagaatgagacgccgaaccgaataaagggattcagggaaattccaaatatagaccccccgcgccagcaaaattctcctgacacagttaattagaaatatgtttagttcaggaacatatcaggcttatggccccccaggaagagactagagggcccttgtctggaaaaataaaaaagcagaaaaaactcaataggaggatctgaagatgtagtcaaaatctccaaaagcaaaaaaaaaaaaaaaattaaaaaataggaagaataaaacatgaaattaagggctcaatgcagggcgtgaaaggtcatcattggaaaagagaccagagacaatggaaggaaaaaaagttactaaaatgatgataacaataacaacataagaccatttcccagaactacaaatttccagattatatggctccacaaagaattcacacaatgaatgaactccgcctctgcctccaaagcccctgactgaacagttttagaatactagtgatgaaaagatcctgaccaggtggagtggctcacacctgtaatcccagcactttgggaggctgaggcgagaggatttcttttgggaccagcctaagcaacatggtgagactgcttaaacccaggaggtccaggctgcaaagagccgtgacctcactatattccagcctgggtgacagagtgagaccctgtctcaaaaagaaaagaaaagaaaattgctgggcgtggtggttcacacctgtaatcccaacacttagggaggccagggcaggtggatcacctgaggtcaggagtttgagatcagcctgaccaacatggcgaaaccccatctctactaaaaatacaaaattagctgggtgtgttggagggtgcctgtaatcccagctacttgggaggctgaggtaggagaatcgcttgaacctggaagacagaggttgcagtgagccgagatcatgccattgcactccagcctgggcaacaagagcgaaaccccattaaaaaaaaaaagaaagaaaggaaggaaggaaggaaagaaagaaaggaaggaaggaaagaaaggaaggaaggaaggaaggaaggaaggaaaggaggaaaggggaaaaatagaaaagaaaatagatcctatactatcccagagagggaaaaaaagaaaaaaaaaaaaaaacagaacagtttacatataaattactgattctcaacaaaagtagaagactaaggaataatgtcttcaaacttctgagtgtgtttcaccccagaattctatgctctgtcagattatcagtgaagtaggagagtagggaaaaaaataacatttccactcaacaaggtctttacatacctacctgccagaccccccttctcaggaagctattgccagctgtgttttgggctcttctctcatgagtcattctggagggaagaagtcattctcgtgtgctgttcccaaaatgagggaatgactcaggagagaagaggacttggatccaggaaatggaatgccttcatcctacaaagaggaaggaagttcaccatgtgtcaggcatgggtctagaccctcggagacagtggggaagaagaggccccccactcccagattccagaagacaaaccacacagaagacggacaagtaaatgacatggatatgtgaagttgttgaatgctggataatccacgtcaaggaatgaaccaacacaggtcctattaaaacaacagaggcgagagtgggatttgtatcgactcctcaacagccttagttgatggagagagaaaaatcctcccatggtctccctgctggaacagatgtgataagtttgactgtgaaatccagttaggttacgtgcacaacagaggattaaaaagaactggccgggcgcggtggctcacgtctgtagtcccagcactttgaaaggccgaggcgggtggatcatctgaggtcaggagtttgagaccaacctcgccaacatggtgaaacccatctctactaaaaatacaaaaattagctgggcatggtggcacatgcctgtaatcccagctactcagtaggctgaggcagaagaatcacttgaacccgggaggcggagattgcagtgagcagagatcgtgccactgcactctagcctgggcgagaagagcgaaactccgtctcaaaaaaaaaaaaaaaaacaaagacattcagttaggcgacttctcccagtgcctatgttcctccacactttttgtagtaatttagagcttactccctggttttacttcctaggcagcgggactcactagggaatgcctggagtcagaaatgtggctctgaattctttttttttttgttgagacagggtgtcactttgtcatccaggctggagtgcagtggcgcaatcatacctcactgcagccttgacctccctgggcaactacaggcgcactccatcatgtctagctaattttttttttttttttggtattttttgtagagacaaggtctcaccatgttgctcagactggtcttgaactcctgggctcaagtgatccacccaccttgacctcccaaagtgttataattgcaggcgtgagccactgtgcccagcctcgggcgagctgccgcttaaccactcaagtcatatccctgcatcttcgaatgggaacagtgactcacactggggcccaaacactccaggccaaacaccccaggtgtcaccaatgcctccacccaatctgcattctcaggcagtgacaggagggtggcattcattgctctaaagcaattgccgggtgcattccaggcttaaggacacagactttcaagaagtcctatgctgggccgagtacagtggctcacacctgtaatcccagcactttggaaggccaagacaggcggatcacttgaggtcagaagttctagaccagcctggcaaacatggtgaaaccctgtctctattcaaaatacaaaaattagccaagcatggtagcacacacttgtaatcccagctactcgggaggctgaggcaggaggatcacctgaacccaggaggcggaggctgcagtgagccaagacctcaccactgcactccagcctgggcaacagagtcagaccttgtctcaaaaaaggaaaagaagtcctatgctggatgtcaggggtacaggcatggaaaggggctgcccattcggaagctctctctgtaggatgtggacagggcagggcaacccaacaccagacctgcctgacctgaaaggctggaagaggcacattgaaagtttgaccccctccttccaaccactccattaaagtcctacaggggctttcccagccctgctcaccttggcacccagattcccaggtgtggctgccctgccagcctgaagcacagcacagtggcctccccctcaaacatgccattcagcccttctggtcttccctcagctcttgtcgccagccctgcctgcccacacactgtccctgctcccgggaaccccctcccaatctcaatgccaagtctcagctaaaaagccacttcccctggatccctccccgttgcccacgccttgctcccacgacacatgtgcttcccatctctacactcattgcacttgcacaggcttgctccccttgaggtgcccgttccctggagccgctcacctgtcctgtccctgggctgccttcctgttcagtgctgggcaccaagcaggcacttcacaaagatttggggaattcaactgaacggaggcacagagcagcatggtggtgcagacaacaacgggtgacttcagggagctagttcaagtcctagctctgccacggtgcggggacctcacttccttgtctacactgcaggggcggaccggcccacccacaggcccctcctacctctaacactcaaaagaataaggcaggggaatggacatctgttggcttgcttgactctgagctaggattttatggtgaggctggtcgcagcggtggcacagtctagcatttatcgatggtggtccccaggccctgtcctcggtgctggagacaaaggacaacaatgaggctcttgttctgaaggccctcagcctgaatcctagcatcccaaagcatcccccaccacctgcttctcactttcccctggggcccctctctgcccaggaggctccggccaacgtcatccagaggagagaaaaagccagaaagcaaaatccaagggtcccgcccagtaacagctttcgaggtgggcctgggaagttcaagccaaagagaatccatcttagaatactcccttgccacctccagagaggaaggtggtggagaaaaggccgcgctgcgccatccaggaggatgggtgtctgcgcccggaaaggcctttgaataaacccatgatatacattttccaagcagttgtctgcaaacgcttcacggcttctggcccatagattccagcttttggagacgaggcctcaaaaactggcaacgcgcaagccgcatctgcccatgggtatgttttgtttggtaggcaaggttttaaatttttttttaattagttccaacatttaaaaatcatctggtttcacgtaaggatccaaatgtccagcttctttagaaaaacaggcggtactaggtggaatataagacatgccttgggaagaaagtccaccagggtcgcagggcaagcaaagatctaggagatcaccatcagtaagctggcggagacggaacctgaagcaggggaagcccagacagccacaggccctgaaccaccagctgcagcctgtgcaggcagacagaacgtccttagctggccccagtccccaacactccctccagcctcacaccaggagcctccttcattcacatgacttactggctcctgcaggcatttagccagcagcctcttagaaagatacagggccaggcctcataaacccacccagggcacaggcctccttccccataatctcatctaccctccctcatacccaaccagctgacactgggaatgaaggcaaagaggacacatctacccaggagaacaatcagaggctttctctgcaggatgctcgccaactatgggacgctcagtacgatacactgaataattgacaatccctctgatgcaccttgtgcttttatcattacacatctgcgtatcgttttaccacgtccaaaatgctaacatgtcaaaatgtggggaaaacatcctcataacttattcatgaagaaaaaaattctatgcaatgaggaactctaagtgacataaattgttatttttattttaaatattggtccatttgaacagctccatttaaaaatggattaactcacccttttaaaaatgattaatatttgatcaacacaagatacctaatctgaagcttaaatcttcccccaaaactaatatgaatcaggtttctttaggcaacttcagaatctattggaaaggcagttgtaactttataagggaaaaaaattatcagagtggaggaaatacctgcgtcttatcttgcattttcttaaaatcttcacatgctagccaaaacaaaacattttcttcactgaattccttttttaaaaattcctgtggatacaaagaaaaagagtcacacagtattctactttaaaaaaaaaataaaacaaatggcatttcccttcaaagactgatttggcaaaattcaacagaggagcatggttcagttactcttcgaaaaccccactctgaaaaacaaatgagtatgtttaatgttaaagctataatttcatatgcatttgaccttaatggttttgacattgtaaagaagagtacaaatgaagcaggaatgtactcatatttctaagctgacaataaattaccaaaaagtaaattaaagtggaagatatattggttccttccagacagtgtttaaacaaagtacattcctctaaaatcaggctgttttttaaacaaaagaaaagaaagcacattaagtatgtctaaagacaccatgatacaaactattttaagttggaggtatgtgtgttttcttatggccgatcttgggcagtccatggcacagccagctactctgctgtgcagagacctcctgagttgcaaacactgctcacagtggcctggcgaccaggaactagaagcctagtaccacctgccactccctccctgggagctccaacaggcaccaactgcatgaggactcatcctattcctgacccaagacttaaagacagaagtaaccaggactcattcttgaaattcacatatggtcctccatctggcaccgggggcttctgctggtcagaaaagctatttctagatgggatcaacagttccccatccatcagccctgctctcggaggtcccttcgccaagttctcattgccagcctctcttactctgtcaacaatgcattctgagaatcccccaagcacgagagaacaagccttcacgtcagagagacccagagctgggaattcctcatacagactccaccaataggcacggtatcttctctctcctcccaccctgtacccctcccacctcactacacaaaaaccagaaacaggctacccatctgtgacagcgttgccaacacagtcatgacagatgagaaagtctcaccctcaagctgggatagacagtactgaactctcaagctggcatagagagtgctacgctgacagacaatgttgaactggcctatttctcccctgtgtgcatctgaacttctgcacacactgcatccatcccgattaacaatgaaaaagacaaaccctaaatcttttcacgccttctgggtcttccagcagattctccagggatgccgcccatttggctgtgctcttgaggctctggtggctgctgctggaactgccatcgctgtcgtggatgtctgcaaagcaaagttcagactgcatatgtggccaacagacactgtcattttaagaaatctgcatgcaatggtcagcactgccgtcaccatcacggctgacatacaccgacttatgcgtcaggctctgttctaggtgcttaacatgatggactcattcttgtcacacaaccctgtaaggcaggcactactatttcctccattttacagatgggggtaaactgaggctcggagggatgaagggacctgctgtttcccaccaaatccttcccctactcttgtgtccactggccaattcagaggcagccctcaagtcacactcaaaccctcctccaagagaaccttgattcaacagcaactgcttccccatggcgctttgtgcacagacttagaattatggtgctgtgttgtgactatttacatgactgactcccactagtctgaaggctcctatgtgtcctcatcttgtatctccagcacctagctcattatctggcacagagattaaaaaactcattgcaggacgggacccacgtgatggcgcaaaatgtcagagggttgccagaatacccaggcatcaagataaatgtcatttcaggcaatagctctttttgtttgtttgtttgtttttgacagagtcactctgtttcccagtctggagtgcagtagcacagtctcggctcactgcaacctctgcctcctagattcaagcgattctcctgcctcagcctcccaagtagctgagattataggtgattcccaccgcacccagctaatttttgtattcttaatagagacggggttttaccatgttggccaggctggtctcgaactcttgacctcaggtgatccacccacctcggcctcccaaagtgctgggattacatgcatgagccaccgcgcccagttcctcaggcaatactttttcaaaaaatcaaaatttatgctaaaaaatccatgatgaacaaaatacccaaattttaaataaagacaggatcggttatgctgatttttccttttgcttcagagtccaatatggctcagcatcacactgttatttttcctgactttatttaaacttcggatatttgttcattacggatgtttctgcattaattttgatcttttaaaacactgcattaaatatcatttataggctgggtgcagtggctcacacttgtaatcccagcactttgggaggccaaggcaggcagatcaccagaggtcaggagtgaaacctcatctctactaaaaatataaaaattagttgggtgtggtggcatgcacctgtaatcccagctccttgagaggctgaggcaggagaaacgcttgaacccaggaagcggaggttgcagtgagccaagatcacaccactgcactccagcctgggcgacagagcaagattccatctaaaaataatgataataaataaataaataaataaataaataaatatcattatcctgatgcctgaggtttttggcaaccctcttacattttggtgcacagagaaaatggatgaaaactctttgcatctgcacatcttccactgtactctctgactcacgacactgagaagtctcctgggaggaacagggaatctccaaataacacactttggccacttgcctgtaggaggagggaacaattaaagcatgcttcattctatggcatgtgatcccttcctggagtcaaggaagaaccatggaatgtcacttcagatggggccaggttcaaaacccagtttctggccgggcacggtggctcacgcctgtaatcctagcactttagggggctgaggcgggtggatcacttgaggtcaggagttcaagaccagcttggccaacatggtgaaaccccgtctgtactaaaaataaaaaaaagtagctgggtgtggtggtgggtgcctgtagtcccagctacttgggaggctgaggcaggggaatcatttgaacctgggaggcggaggttgcagtgagccaagatcgtgccactgcactctagtctgggtgacaagagcgaaactctgactcaaacgaaacaaaacaaaacaaaacaaaaaacccagtttccccaattcaaaactataggatcttgggcaaaattcttgtgtatatttgaaaatcatcccccatctcttgggttatcataaggattcaaaaatggaagcacatcaggcacctagcagcacacttgggacacagtagatgctcaacaaatgtgagctcctttcttcccatctctaaaataaccatctatcaagcaaactacttctataactaacacttttttccccattgactttttttctttccaaagctagagacatgtttctataaaaaaaagttcaaatctaggagaaaataaacttttaattaagaaatcagcaaggccgggcgaggtggctcactcctgtaatcccagcactttgggaggccgaggcaggcagattgcaaggtcaagagatcgagaccatcatggccaacatggtgaaaccctgtctctactaaaaatacaaaaatttgctgggcatggtggtggatgtctgtaatcccagctaccagggaggctaaggcaggcgaactgcttgaacccgggaggcggaggttgcagtgagctgagattgcaccactgcactccagcctggtgacagagcgagactccatctgattaaataaatacataaataaatcagcacagcaaaccacctctaaatgatatatttttttaaataaagtctcataaatattaattgctgcaaacagctagggggccacacagctaaaaatggttttggagaaaatctgtatcagagcacactggacttacttaatagtaacagctcctgtgatctctgatgttctatggggggtcaaaatacatgttgacttcttgatcccctgggactccaaatccaagcacctggggaaactaccaggattttagacattcaccagatgacatgagctaaattagaaccaggccagctgggcacagtggctcatgcctgtaatccaaacaccttgggaggctgagacaggaggatggcttgatctcaggagttcaagaccagcctgagcaacatactgggaccccatctctataaaatatttaaaaactaggctgggcacggtggttcacacctataaccccagcactttgggaggcccaggtgggcagatcactcaagctcaggtgttcgagaccagcctgggcaacatagtgaaatcctgtgtgtacaaaaaatacaaaacttagctgggcatagtggcatgtgcctttagtcccagctatttgacagactgaggcaggaggatagcttgagcccaggagttcaaggctgcagtgatccatgattgggccactgtactccagcctggatgacagcaagaccctgtctcaatcaatcaatcatcaataaagcagaaacccagaaacccagcagggaccatgcttcaatgctcattggcaatagagtacgtaagagaattatttgggacaaatcctttcctctaaccatgaaggaaactcacttaaacacatcaccaaatggagctgatgcttttctaaagtgaccctccagttcgtggatattaaattagttccctgttctctttgtaaatgctgcagtggcaagttcctgaacactgagtttctttccaacaaagtataaatccaattaaaagatcattattacaagaaatttctgcagcagggttcattctgccaagcattccactaatttactcttctgctctttgcccagagaatacagtttgacagtttactccatttccccagcagatcttctcttaagtaaataaatctagagacacaagttcactgttccaggaacaatctaggcagctgcaaatttctcttgccatggcagaaccactttggccataagttttcaaccttggtctgaaaggattccaaaactcttgacattcttttccataataaaccagaccatgtttgggttttcactgccacgctgtcttgcaaataaatacacacagtagattaccatttagccaacaaaatgtctgagagttaaaagaactgacctcactgttagacaattgccaacccccaccctttatttcatactctaatcatttttgcatattaggtttatgtgttcaaatgtgttttcatttgaacaaaaaattttacaactcaaaacacactaatgtggtccaggcccacctcccccaccacctcattttatagactgggaagcaaaaatccagaagatagaatgacctatccaaggtgatgcagctaatgaatcactggatggacccaatactgggacctgtatgggaggtcagctgtcctcaccagggccatgtctgcagaatcccagggctcctgggaacatagttagaaaaccgatgggcccttccattccatggtctcctgggctaagatctcccttatatcatatgccatgaaatacgttaacaattgacactattacagaagagcatggagttttcagggacgggtcagaaagtatgccaagatggagctgctttttatagccatgggtattggttttctggctatggtgctctagataaagagcaattccttcttgcctttttgctcaccttctgtccccataagtggaatagaagatccttctatctgagatacctgctctctatctgtcataagtttttattttccccaaaaatgttggtttgaatttttctaagacttcctgactgtctttcaagtttaaggcttttggctatggcaccccacccttttcaaatccatcttgactgatatcagtatagacagatcttgatgagacagcatttgcaaactccactcacccagtggcatctctcttttccaagtcactatccccagcctccaatatgactgagcagacagggatagcccttaggctgagggcacttctgcaactcagggtcccctgctcaggggacacactaagtaatgaattcctaagccatctcagctcagttacgacccgtgggcgcggtggctcatgcctgtaataccagcactttgggaggccaaggcaggcagattgcttgagctcaggagttcaagaccagcctgggcaacatggtgaaatcccgtctccacaaaaaatacaaaaattaggccaggcgtggcaactcacaccagcactttgggaggacgagatgggcagatcacaaagtcaggagttcgagatcagcctggccaacatggtgaaaccctgtctctactaaagatacaaacaattagcctggagtggtggtgcgcacctgtaatcccagctactcgggaggctgaggcaggagaattacttgaacccaggaggtggaggttgcagtgagccgagatggcaccattgcactccagcctgggtgacagggcaagactctgtctcaaacaaaacaaaataaaacaaaaacaaacaaaccaaaaaaaccacaaaaattagctggtcatggtggtatgggcctgtaggcccagctattcaggaggctgaggtggaaggatcactcgagcccaggaagcagaaactacagtgagccgatattgcgccactgcactccagcctgggtgacagagccagacgctgtctcaaaaaaaaaaaaaaaaaatcataaaaaaagaaaagaggccgggcacagtggctcacgcctataatcccagcactttaggaggctgaggcagccagatcacgaggtcagttcaaaacctgcctggccaacatggaatacaaaaattagccgggcatggtggcacgcacctgtaatcctagctactcaggaggctgaggcaggagaattgtttgaacccgggaggcggaagttgcagtgagctgagattgcgccactgcactccagcctgggtgacagagagagactccgtcttagggaaaaaagtttaaaaaaaaaaagaaaaaaatgttaacaaccaaggtggaaggggaagcaggttaaagtaagtaagtaaataaatacatatatacatacataaataaatgttacaaccagtccagtaatattagaagaaataaatactctttctcaatagcaaagcaggtttacctctgaacttaagaataaagcaaaaccaagatttcccagctgcccaacttctggtacctggatccacaaagttgcaatattcttctatcccttttcattgataaaagtttccatttcagacagattacacaagaaagcaggactgacatgaataggtggaaaaaatgtcaggcatgttctccagcagctttacgatctctccagctagggaagacctgcttgtgatatttgtttgtttcaattttatcatgctgttttatttttgttgtcattgtttacttcagctgtaaaacatttttgcaatgaataaaagtttttggtgtttcattttgttttcttagctcctgggctctttacgtcattttagatcttcaaattttttgcatgcaaaatacgtatttttcagcaaatttattttcagactactctgtcattagctaataataatggttaatacttcagatgggccaggcatggtggctcacacctgtaatcccagcactttgggaggccgaggtgggtggatcacttgaggccaggcattcaagaccagcctgggcaacatggcaaaaccacgtctctacaaaaaatacaaaaattagccgggtatggtggtgcactcctgtaatccccagctacacgggaggctgagacaggagaatcacttgaacccgggaggcggaggttgcagtgagctgagatcataccactgcactccagcctgagcaacaaaacaagaacctgtcttaaaataaataaataaataaataaataaataaataaataaataaataaataaaaaaggccaggcactgtggctcatgtctgtaatcccagcactttgggaggccgaggcaggcggatcacgaggtcaggagttcaagaccagcctgaacaatacgatgaaaccctgtctctactaaaattacaaaaattagccaggcatggtagcacgtgcctatagtctcagctactcgggaggctgaggcagaagaattgcttgaacccaggaggcggaggttgcagtcagccgagatcgtgccactacactccagcctgggtgacagagcgagactctgtctcaaaaaaaaaaaaaaaaaaaggttggcgcggtggctcacgcctgtaatcccagcactttgggaggctgaggcaggcagatcacgaggtcaagagatcgaaaccatcctagccaatgtgctgaaaccccatctatactaaaaatacaaaaaattagccaggtgtggtggtgcacgcctgtagttccagctactcgggaggctgaagcaggaggattgcttgaacctgggaggcggaggttgcagtgagccgagatcaagccactgcactccagcctggtgacagagcaagactctgtctcaaaaaaataaaaagaaaaaagaaaaacttgcaaatgatttacagtgtgctgggtaccgttccaagcttttacctgaattaaatgattcagttctcacaataacctactgacgtggttagtattatttccactttgcagacgaagaaactgaggcacggtaacttacaagcgtcccagctagaaaatgggaaatcacggcccaaacccaggtactcctgctccagagtacacgctctttaccaagggctctactgccatttttagcttttatatctgctgatctttatactcacagaggccagaacacaacagcctttaagagaccaagaacaatcacactttggggaaaaaacagaaaactgttaagagtccaatccatgcagaaaaaaaaaaaaaaaaagtcacataagaccaggtggaatcatccagcacacaaacacaatgtatatgcgttttccatttatgattatgctgtcctatgtggcttctggcgtcagtaaaagccattatttcaaggatgggtgaagcatcacagtgcagatggctggggctggttgcttgcagcttattttatgatgcattatttatagatgctatgatgtcatatctaacagagaccttctccagacattaattccttggaaatccatactcaaaaggcatctgtaacactcatcggagatgaatgctcacagcatggatttctgctgttaatttgcaggaaggtctgtgtaatcatcctgcatagacaatttctccaagtcaaataatattttagtaatatctcactatccagtttcctcaacagcagagtcaacttacatcctcagaaggtttgtcctaagtactcccccaaactcacagactattaaacattcgagtccaggaaaaggcagagatattaaccctaaattccaaagtggtttggtacaactcacatgcacaggcgtgcacacacacactgtactcctttaaaatactctactttgtaatgaagtttcaaagaaagtacacaccccacaaaacttatttaaaacctcttgtcacctataccacatcaagtgtagtacattttttaaaaagtcctcccaatttagaatcagagagtcattttgttacaactggtgatctgtgtaaggctccagagaaactgggtcatggaaacatggtatctaaatattacttaagtgtttatcggctccagtatctagctgctgagaataactaccccacctgcatgcaattcccttgccagagagatctgattgaactgcagttagcaggaaataacatcaaaagtgaaaaaagtttttcaataatcatagtaatagccagcatccaagtcaggagcaggaaagctggtggcagagggttggctccactcagaaagggcatcgtggcgttttcacacgagggttcgggactcacagaaagccaagtgctcctactggcccttccacagtcacctgtgcacctctgtgtcctcacagcacactcttcccagcccctgccccgcccagggccaaggcgacaggcaaactgcggacatggaaaggggtgggggcgattccttacgttccatgctctggtgtccacctgagaagttccacgcagaccaacaatccactgccttcccagagacgccttgtgtgagaaaggcagagactggagggctcccgagcacccttgggtccgaagaaaaaacaagcctcaacatcctcttttaagtggactaaacaacagatggccactggtttccagtttctactagagggaaggaaataagaacgccaaactgttatttgtagcctccctagactctccactttctaggcaaagtccagaaaaaagaaaatggcccagcagccctagcccgaaaacaaagaccctgtcatcgattttctccacttccagaagcccctgtgtgtcctctggggcctgacatttctgcgtaaagctgccctcaccctcctactctgcctcaatctgtcccgcaccctccctcgaggcaaagtaaatgactttttcctccagggtcagtcaggtggatggtgcatttcttgaaagcaagggctgagtcttcctcagggtcagcatgatgtctggcactcaagtatatattttatagtgataaacattttctaaggaatgagccaagccaggcaccaggctaagggtagagggcacagaaaggaggacggatagctattaaaaatagttgaggccaggcgtggtggctcacgcctgtaatcccagcactttgggaggccgaggcgggcagatcacctgaggtcgggagtttgagaccagcccgaccaatgtggagaaacctaaaaatacaaaattagccaggcgtggtggtgcatgcgtgtaatcccagctactcaggaggctgaggcaggagaatggcttgaaccccggaggtagaggttgccgtgagccgagattgcgccattgcactccagcgtgggcaacaagagtgaaactccgtctcaaaaaaaaaaaaaagaaaaagaaaagttgacatttactgagcacttactatatcccatcgaaactttgcaacaatccttgcaagctagtttcctcaagggccccattttacagatcaggaaactgaggcacagagacgataaataatttgctacaaagaagcaagcaaggaagtggatgagctgggatgcaaccccaggttgtctggctggagagaaaaacacagagaaagatgccagaaatgaaaggtgggggctattttctcacagaacttaaaatgaattgaggagaggaggccaggggttcccaggtggccgcctgcccacagtgccacgggctggtaggcggttttcttcactagtccacaaataaacgagaaggaagactaggaaatatttaccaagtgaactgtgctggtagaggaaggacagtcttgggttgcttgttttgcttttgctttgaaatagatcactatgtttctttacgtggggcacagtgcaggacatacaaaagggagtgtggtgtaatagtcttcctcacacctctgtccctcaggtgcccagtgtctctccccaggagcgacaacctctacaagattctgtggatcaggacagctctttacctgagattatatctttcctactattgggggtgttaaaatgtccttttctgtgtgaaatgataaaggtgtttgatgatggctttgtttgtttctaatgtcctgactacagaaaagaaggaagggagggaaggagggagggaagaaggaagggagggagggagtggaggagagagggatggaggaagggaggaaagttgtcagctccacattcattctctaaatatattttagcaaagtcgctaaatggttgttgtgtttaggtggccgtggacttgggtccaagacttgagttctctgccccttcagaaatgggtgcctccggacaagtccctgccccttagtggcctctgcagcccttgagggagaaatgaaatggttccctcctgctcagacaagctgctctgtcaagcatggagggtgggaggcagcgaggcctagaagggtgggtctgttggagcagggggacccaggctttgggacaggacaaaggacagctgggggagcaaaggcacagagggagtattgtccagtccctccaggggtagagtagggagcaggaaaaatggggctgggaaggactcagtcagataaggggtcccccaccaggcagtggggcagcaaggtggacctgagggagcttagcagggctcttgacagatgggaacttgcttggaagggaaatttgtccccacaagtctgcaagggactgtctcactccagcggatgccgcctgacagctcttatcaaggggccactgctgctgcctgctggggccccctccgctcctgctgccacccgcaggctgctgcagcaaagaactatctgggggaagcagaagaaacttgggggcataaatttagtgcagtttaagcaacaggttcccagagcccagcatctggggactcactccacccagggagggaagtgactcagttcacccaggaagccctaggaaatggccatgccaggcatctacattttctaaccatgaagaaaggagacatcacatcaaatacaaatcagccaacagagataaaacaccgtgagcacctcacacccaccaggctacgggctgcactaggtggtgcccagagcaggtcccagaggctcaactggctcataagctgaccacacctatagaaaacaaggcccttcggctggcccctctgtccccccaggcctgggccagtgatattctgcagagaaagttgtcccagctgccaaggctaccctgctgccgagttgttaaaacaaagacattaaattgctgtgcaaactgtcatctttaaataaaacaagcccagccataaacttaaaactgttcccaagggtttaatcggatcctgtatgacaggcccgaggggacggccgaaacctgcccggcagggtgggaattcccctgagaggtcacccctgggtgcagctgcaggggtagggagtcgggtggcttcagcttggcatctcagatgggcatatttcagctatcaacaatgcaaggttgataactgggcagggtgagtggacagaatcccgttgggggaccctcacatttcactggcctgagaattctctggggtgcttgtcaaagacaagccccacctacagtccccaacactgaatcagtctgggcaaggcctgagaagctgcactttatcaaagccctcctgaacccacaggacgggtggaacacactttgagaaacctcaggaagaataaggaaatcccactctgaaccttggaaggaggggttaggaactcaaaatcctccgcggaaagacagtgtctccagtgagattttgctgaaaggtaggaaaagtgtaaaatagaaggtactgggggaggcaggaccacagccaggtccaaatcaggggtcctgcaggagcagctctggcttttgtggagcctgaagtttatacaatttgaggatcctctttaagaaaaataattcaaaattacaaaaaaaaaaaaaaaattaagtacagggtcccaaaaatcacttggctgtcttctcagtacctcggcccacaggcccaaatgacccctttctcactaggcttcttcttttcacacggctgggtggtgatgaccagtcaggcaagaacttatgttattttccataatggggaaagaccctacacctacaattccaaagaaaatcaggctattggagtggaggcatccagtaccaatccatgatgtttagtggctgatcttccttccttccttccttttttcttccttcctcccttccttccttctttccttttctttggatctcactctgtcacccagggtgaagtgcagtggcacgatctaagctcactgtagcctcaacctcccaggctcaagccatcctctcacttcagccgtctaaggagctgggactacaggcacgcatcaccatgcctggctaattttttaatttttttgtagagacggggttttgccatgtttcccaggcttatctggaactcctgggctcaagcaatcctcctgcctcagcctcccaaagtgctgggatcacaggtgtgagccactgagcccggcctgagaccgacctttctgtcagtgatgtaaccacattttatgaggtttaaaatttgttgccctgaaataatttgttccctaaaactgccttcagcctttttggggtgcaacctggctacacgcaaaatcaccccaaatccatgtatctcccaggatacaatggttctatctgtcagtcttcaacccaaaagcaatctaaagtaataagtaacgcgtacagggctattcatagcagctctatttataacaggcaaaagggagaaaagctactaattattacacttttattatgtgccacacattgtactaggggcttcatatggttttgagtatttaatcccataaccctatgaaacccactttgcaggtggagaaaggtgctggaacatcagctctcctgagtcaaaatgaagccttcatttttagctttgttgattttcatgatgtaaatatcccatcataactactttcaagctacctatggtttacaaccagtttccaaactttttgaatatttggcaactggctcttgcaagccagtttgagccagctccagcacatcactgaaacggaggcacagagagatcaagtaatttgcccagtgttgctgaatgacagagtcaaggttagaaccaagagtttaattcgagtccaggctctgagcagcgctccacaggcctgtgccaaccatagagactggttaacattaacacccacaagggaattctttgactcacatgcaacacaaaaaggtttacatgaccactaacgctaacggagcacttagtacttgccgggcaacaatgtaagatcattacaacaaccctatgaaatcctacatattaaatacaataatttgcaaaacctgatggatggaagacaggttccaattaagtactttaaaaggcgagtagctactgttattcccactgtgcagaacctcattctgcagaaaggtcccacggctggtgaatatggcgaaggtgagattcggatccagccagtctggtcccagtctctaaaccacaatgtccctcataaaataccaggagcagaaaggaaatgcaccaacgcgttgggactctgagcgccaagcagaagtgaatcttggcgtgggaagcccggcaaagcccccgaacttcagagtcaggggaacctgggtttgaaagcctccccatcacctgcggagtgtgactggggcaagttacctaacagcgcctggcttccgctccctcctcactcaccgggttgtcctaggggtgaagggagagttcacccaacgcggtggacaaagcccttggcgcacccaaaggcctgcacaggtcgtagctattgtgatgagcaaaagggtggaaggaccggaatcaagggcacggctccaccttcaccgtggggtctttggcctatcaagttgcccgagatcgtggctcaggctggcccaaagtgacggccaaggcgaatccttcgtaacgtcagaacttcgctggctcggaccgcagaagtgcccttctccatcctggggttccgccaccctcgcgatcccaccttttggctcctcgcggcagaagcgaaggcccccgacgccccaggcccaggggcccagtcggatgcccgggtccagccgtgctcccccgggcgctcggcatccttccacccacgcccgcagcggaggcggagagcgtcacggagggagaagcccgcgcgccgttccgctttcggaatctggagccccatgtcacctccaaagtttggagatttggggcgctcctttttctcccagaccatcactaaaaagaaaactgcggctgttcctctttcagccaaacttcctccccggggctcccggaggagctctgcgctcccgtcgcggctgggaccgcgaaggtgcggtacccagcggggagaggtggtgcggtcggccggggctccagtctgggaggtaccaccgagccgcgcccgagcacaagagggagggcaggaggccgggcgggcgaaacggcgccccgaccccgagcccgcgggcccccgaagccgcttacctgacggcggccgcttcctgctcagccggctcacggcgcggttgaacatcgccgcgggcgcccgaggaggaagaaggagcagcccggcggcgcggcggctgagccggaggaaggcgaggaggaggaggagggcgaggaggaggaggaggagggcaaggaggaggagcgggctcagcaccgccccggagctctaggtccccgcccgccgccctcctcctagccaggcgccgcgtggcgcgctcagtgcgccctgcccgcccccgctggtgaggactcgcggttccgctccggggtgcccgggcggggcagggcagggcagccccgggtgacccccgatcgcccagagtgtgccccgcgcctgggataaggtgcactggcccagagggagcccgcgccgccgggaacttagtagccccgcggaggcggttagcgcgtcccggggtccctggccctcgcctgagatgccgccccggcccgccccgcccagcttcaagctcccgggcccatcgcggtctcccgccttctccctgtagccccggagaaactggcacggcgccgcgggcgcaccgcgcttcggggctctcagcgagccttcgcaggtggcgggcggggtcccctcccgggtcacaggctgggaagcctaggcctcgcggttctgcagagtccgggcgcggcccagcctgtggcctttgcctcctcgtcaccaggatccccgcctgctggggcctggctgctcctcgacttcgtgggcgctgcgccttcccgccccgcgaatgcgggtggggcgtccccagggcccgtgcgctgagctagccgagccgccgcgggtgggcgccctctccccggccgtgccgcgcgggcgccaggactcggggagatctgagaggattctgcaggaaccccccggttcctgcgccgggcggtgctctgtcccgcacaccgcgctctcgggacacttctctaactttggggacacgtgggcactgcctctggcagggccttcaggctccacgaccgggaccactcaagcccccacggcgtcacctgctgggcgctgcgcgctctacggtctcctattatttcatttcttctatggagcagccccagaggggatgtcattagcccccattttcttgaacatttggtttgcaagaaattgtctttctggcgagttttatttttctccttgtgtatctggctttgtctctaaattggtctttatttttagctgtactaattgctatttttccaaaccgttccccagtcgccctccccccatccccccgtccttttgcagtttttttcactacttggcactttcttttgtatcttctattctgagcttccagttctgctcactttccctctccctctacccaccccacagccccagttgcaccccaagtgtggccggtggttgcttgttgtttccctccccgctattccccctccaaaagtcgttttcctccgagcatttccaagcactctcccccttctgctgccaaaagaggatttccaggctcctgaagcgaacgcggtgaccaagaacagggttagacccagcgcggggagttctgcttttaaaactgctgttgttggcctactccgggcccagacaaacttccatctcattgtaatgggatcaagctgtgatacttaactataggcaagagtttcacctttcgtaagagcgggattttaaatgctggcagagtcctggatccaagtgaggtcactgcgttcttaaaacaataagggaattggtgcaacgcactcacccagaaaacttccccgagaccaaattacaagtaatcctaagacaggaaataagcacactggcacacaggggtaaaagttaggcacagcagctcagtgttttgctagttgccaagtccaccctagcgtgtcctgaaaaacactggtgtggcttaagacatgctatgaatccctcctgagctaagaaccccaggcatctcttaaataaagggaaaatataacagccttaaatcacttttactgtcctgttagcacatcagagagtaagtacaaaaattaagatgcatagttagggccaggcgctgtggctcacgtctgtaatcccagcactttgggaggcagaggcaggcggattacctgaggtcaggagttcaagaccagcctggctaacatggtgaagccccatctgtactaaaaatacaaaaattagccaggcctggtggcaggtgcctgtaatcccagctactcaggaggctgacacagaagaatcacttgagcctgggaggaggaggttgcagtgagccaagatctgaaggaggaggttgcagtgagctgagatctcaccactgcactccagcctgggccacagagcaagactctgtctccaaaaaaaggaaaaaaaggccgggtgcggtggttcacacctgtaatcccagcactttgggaggccaaggcgggcggatcacctgaggtcgggagttcgagaccagcctgacgaacatggtgaaacctcatctctactaaaaatacaaaattagccaggcgcggtggcaggcatctgtaatcccagctactcaggaggctgaggcaggagaatcgcttgaacccgggaggcagagtttgcagtgaactgagatcgagccattgcactccagcctgggtgactgagcaagactccatctcaaaaaaaaaaaaaaaaaaaatgcatggttaacgtttaagtgcacagtttaaaatttttgcctgggacattgaaattgctataaatacctgttttaagtgtctgaaggttcaaaagccagttttcaaagtgtattgtgcaaaagaccacgtataaaagtataaagcctcctaactcctaaaactcgccaaatgcacacacacatacacacacacactcacacacacacacacacacacacacacgattaagttccaaccgtggtttgcattggattgaaggtgctcaccatcccaatggcatttttcctgtaattccagcatgcactttctgaagcttttttttttttttttttttttttttgagacagaggtttcactatgttgtccaggctgatttctgacttctgggctctcaagtgatcctccctccttagcctcctaagtcaagccttcacaaacaaactgcggtagccagtgtggggaagaagaggatgagcggtttagcccctttcttcccctgctggtctcacttttggttcaaggatgtttacatcaggcaagaagcaagagccccggatgtcttctggtaacacaagatttcagagggattactggctttggagttcaatattttcattctacccagaaactaaaatattggtaagctgtgaatacattttagagcctctcatcaccagaatttatgtaacaagactattctaggccagttgaggcagacaaggtatagtaaaatgaataagtggccaacttaaagtcaagagacctgggtactaatctgaccaaacagcaaccagctgtgtggacacaccagatgtgtcctcaaacacatcgtagcctcaagggacagggcaaggagaggtccacctacactccgagcaagtggtattcaatagcaataaacaaaaaagcatctggcatcgtgcccagcacatgtaggcacacaaaaaattactggaattttaattactcttactccccctacaatgatgttttaataaatgataaactttatggtacagccagtcaaaagtggatttcttttcaattataggaaattggcagggttagtaacactgatgttcacattgttactacactgtgaaggagggaaagtaaattgttacaacctctctagaaggaagagaagcagatgtgttaatatatgtatttgacaacacatgtaagagtcttcaaaatgtttatacctcttggactagtgaataattctataattggtaatttgtgccaaaagaaaaacaataaatgatgcgaacatttacgtgtacaattaaacataacacttccttttatcagggttatttacagtagctaaaaatgcccgctaagagaatgactaaggtataacatattctcctgatagaatatttaacagttataaaaaactgtgaagaatctttggaacttggtggaaaaaactagtgcaaagagaaagatgaaagaatcttagacgaagctctcgttgaaaaatcaggatacaaatatagagaaaattttcagtgtggaggaagaggagaatacggtatgtttatacctagaaagctagcagttaattacacctaaatattactagactatatctctagataataggataatgggttcttttttcttcattacattttcctgttttgcaaacttctgcagtgtatgtgcttttaaatcagggagaaaaatcactaattagagactagttgaaatctctactgggtttaatgccacaaaaatacataaggcttcatttctgttgcagttttgtgttttgttttttagagacagggacttgttctgtcgcccaggctggagtgtggtgctgcgatcatagctcactgcagccttgaactcctgagctcaggcagtccccctacctcagtctcctgagtagctagggctacaggagtgcaccaccataccctgctacttatgtatgtacgtacgtatgtatttatttattcattaatttttttatttttaattttgtttatttatttatttatttatttgagatggagtctcaaataaataaatagagatgggatttcaccatgttggccaggctggtctccatctcctgatctcgtgatctgcccacctcggcctcccagagggctgggattacgtaagccactgcacctggcaaaagtaaattttatttttagagcaattttaggttcacagcaaaattgaacagaaagtagagttccacatgcctcctgccccaaacacgcatagcctcttatagcatatgacctcccacaccagagaggtacctttgtgcaatcaaggaacctacaatgacacatcgttatcatccagagttcatatcaaatacccttttcccatctcaggactcccaccttttttggagggtgtggggctaaggagcagaaagtttaatacgcaggagtaagagaaaggagaacagttctctctctagggagagagaggggcttccgaaaggaaagaccaacagtggtggggttcactggattttataggcagacttgagaaggcggtgaatgatttacatagggcccacagattggttagatcagatgtgacgtttacaaagcgcccagggaaggctggccaccccaccctaatcttactacacaaatgagttttccacttgactggtgacatcttgtctgctccttatacacatgtggctggcaaagacaagggaagatggagccgccattctgaacatgcctagtcccaagtagctttttttctgccggcattcacccgtgcaagcatccagcttgcttgtctatgtctgcagccgggcgtggcggcacatgcctgtaatcccagctactcgggaggctgaggcaggagaatcgcttgatcctgggaggcggaggttgcggtgggccgagattgtgccattgcactccagcctgggcaacaagagtgaaacgctatctcaaaaaaaaaaaaaagaaagaaaagaaagaaggaaggaaggaaggaaggaagggaggaagggaggaaggaagggaggaaggaaggaaggaaagaaaagaaaaaggagacaacaatgggagagagatttcagccaatcagaaaggagatggagaagcagaaacacttaacaagaggaaggagctacaacctaaatgcaggcagggcgtgccagttagaacaagccaattcaccctgcagagcctcagaggagctcctgacccaaaggcacagaccacagagaagaggacaggcaaggactgaaaaggggagattgatagaagtctatataaggagacttcagttcccctgccacctaccttaggaaataatgatcttgggaaatagtgaagtacagaagctctggacttatgaactactggctgagctaaaggtgcagatgagctgtgggcatcaaagagagtgttaagcctagatctgtacacaggattgggaggcccttcttcctcagccccttccccagcagccagatgtactagaaaaatttactctctccaaaacaaaaaacaaaacaaaacaatggaaattaacatttaacgttctccagagttagcactggccaactacacagacatacacaatccacatgcctctttcacacacacagttccaaagagctttggacacctccttctcaaggatgaggactatgcaaagaccacagacatttaaggaacgtctctaatgagagagacagagagaaatagaaaataggaattcaggcgaaagacaagagagaataggcatgaatcttttaaaatactataactagctcagagagggagagagagaagctatttcatccattcataaaagaagaaagattggaatataaaaatgaagtagaaacaaaacatttcaataaaggagtttgaagataaaggtgaagaaatctcctgaagattagagcagatgaagaaatgtacaacaggagagaaagaaagaaagattggagaatcaatccaagtaataggagttccagaaagacattacagagaaaatgttagagagaaaattaaagatataattcaagaaaattgcccagactgagatgggcatggtggtgtgacctgtagtcccagctactcaggaggctggggcagctggactgcttaagctcaggagtttgaggctgtagtgtgctgtgatctcacctatgaatagtcatagcactccagcctgggcaacatatcaagactccatctcttaaaaaaaaaaaaaagaatgaatgaaaatttcccacactgaagaaaattcatctccaaaagcaaagagtccataacgggcacaatgtgagacctacaacaaggtacacctgcataaaatttcaaaacaaagacaatttccaaaaaaaaactcagaaagagcacattggtggtgggaatactaaatggtacagccactctcaaaggtgacttggaagtttcttaaaaagttaaatacatacctatcatatcatccaaacattccactcttaggtatttaacccaagaaaagtgaaaacgtgtccatacaaaaactcttacatgagtgttcatgccagctttagttgtcataacctggaaacaacccaatgtctgtcagcagctgcatggataaacaaattgtggtataaacatacaaaagaatgaattattgacacattcaaaaacataggtaaatatcaaaataattactctcaatgaaaaaaaaaacagaccaaaaaagatatatactgtatgatttcatttatgtaaaattctagaaaatgcaaactaaactatagtaacagaaacagatcagtggttgtttgggggagaatagggagtaggggtaggggagtgatagaaaggatggatttctttttgtttttttgagacagagtctcgttctgtcacccaggctggggtgcagtgccagtggctcaatctcagctcactgcaaactccacctcccaggttcaagcaattctcctgcctcagcatcctgagtagctgggattacaggcatatgccaccatgcccagctagttgctttttttttttttttttcttgagacggggtctcactctgtcacccaggctggagtgcagtggcatgatcttggctcactgcaatctcgcctccctggttcaagcgattctcctgcctcagcctcccgagtagctaggattataggtgtgcgccaccatgcccggctaatttttctgtttttagtagagacggggtttcaccatgttggccaggctggtctcaaactcctgacctcaagtgatccgtctgccttgacctcccaaagtgctgggattacaagcgtaagcgatcgtgcccggcccagctaatttttgtatttttaagagacagggtttcgccatgttggccagggtggtctcgaactcctggcctcaagtgatctgcctgcctcagcctctcaaagtgctggtattacaggcatgagccactgcacccagctgaaaggatggatttcaaaggggcatgaaggttattttgagttgacatgttcactatcttgactgtggtgatggttttgtaagtgtatacatgtcaaaacttatatagtttatatatgtgcattccattgtatgtaattttatctcaataaagctgtttgtaaaagtatgtatgtgctgagaatgtaaaatgatgcagcccctttggaaaacagttgggcagttcctcaaaaagctccatgtggagttaccatatcactcagcaattccacttctgcatgtctactctagagaaatgaaaacatacgtccacgctaaaacttgtacacaaaggtccatagcagaaaagcagaaacaacccatgtccatcagctgacgatgcacaggcaaacctggtagctctccatctattacatggaatattattcaaccataaaaaggaatgcagtactgatacgctacaccatggatgagcctcacaggggagccagtgatcacctctaataccccttttggctcttagtgggctcttcagctggatctagaaaccaaactgacaccaagctgatcaacaagagcgaagtatacacattttattagtttggcatgtacgtggagatcttcacaagagactcaagtctcaagtggctaaagcaaaatgctttttttctgcatcacttggactacacagagcaagatgcttttatactttttagacaaagaacaatagatttgaggaggaaaaaataggacaaagaaaatctggcaagggcgataaaatgttctaggagatccactaggagatacaggagggggtgtaaataggtggaagataagtgttatttcatgaagtatgtttattcaggtccattgccgtcctcagttccagtctctggtgataagggctattttctctctctggtttggagaggggacccctcccagaggaatctttaccgcttgatgcatgcaggaagagggaggtcagctggccctttctgaagccaccatttctccaatgtttgcaacttgaaataatcgatataccaactaggcatattttggggtggcgcgtccttcatgctctcaaccttgaaaatgttacggtaagtgaaagagtatcacagagagcatcccatgctgcatgattccatttataccaagtctagaataggcaaatctgtagagacaaaaagtaaatttgcaatctcctaagcctgggaacaagggaagaaggggaatgactataataggtacctggtttctttttggatcatgacaaagttccaaaattagattatgttgatggtttcacaaccccataaatacattaggaaccatttaattgtgtgctttacataggcaagttttttggtatataaattctatctcaacaaaactgtttatttacaaagagcaaaaacaggtcacatacaaaggatcagaaatcaaaatgtcactggactttctggaaagctagaaagcttgagggatatcctgaaaaaaaaaaaaaaaaaaaggatcaggtgcagtgtaatttcagcacaggtgggtggcttgagcccaggagttcgagaccagcctaggcaacacagtgagaccctgtctctccaaaacaaaaatacaaacattagctctgcgtggtggtgcatacctgcagtcccggctcctggggcgggggctgagggctgaggtgggaggattgcttgagcccagaaggttgaggctgcagtgagccgagatcatgccaccgcattccagcctgggtgacaaaggaagacctcatctgaaaaaataaaaggagtaaatgcaaaaagagagggcagcacaggctccagagaacaagggcccaacctgggagagcagcagagtcctgatcagggtaacaggagtgcagtgggactatggcagcaggtgctgggggaagcacgagagaagcctctagaagcctcctttgatgaccttgaatttgagaaactgtattgaaaaccatttgattctaccaggcgtggtggctcacgcctgtaatcccagcactttggaaggctgaggcgggtggatcacttgaggccagaagtttgagaccagcctggccaacatgacaaaatcctgtttctactaaaaatacaaaaattagccagatgtgatggcttgtacctgtaatgccagttactcaggaggctgaagcaggaaaattgcttgaatctgggaggcggaggttgcagtgagccaagatcatgccactgtactccagcctgggcgacagagcaagactctcaaaaaaaaaaaaagaagaagaagaaaggatggaaggaaggaaggaaggaaggaatgaacaaaagaaagaaagaaagaaaaagagagaaaagaagaatcagtagtatatgcatattgttcagatagatggaggcaaatactagaagaacagctgagaatgaaagatgagtagcttttgaggagtaggcctgggagaggagggtgaaagggagtgctggggttttttgttttgttttgtttgttttattttgttttgtttttcagatggagtcttactctattgctcaggctggagtgcaatggtgagatcttggctcactgcaacctctacctcccgggttcaagcaattctcctgcctcatcctcctgagtagctgcgattacaggtatgcaccaccactcccggctaatttttttgtattgttagtagagacgggaggtttcaccatgttggccaggctggtctcgaactcttgaccttcgtgatccgcccacctcggcctcccaaagtgttaggattacaggcgggagtcaccacacccggctgggagtgctgtttttcataagacttttagtacactttggctttttagactattatacagatatattattttaatgaaaataaaaattaatttaaaaaagttctagtagtcaccacttgcctagtccataacaaaagagaggacttggtggtatcaccaataatagtaacagctaaatttcactgagtactcactatgtacttggcactgttttatcttatcttttaatttttaacatttttctagaaatggagtcttgctcctccacccaagctggagtgcagtggctcagtcaaaggtcactgcagcctcaacctcctgggctccagcgttcctcccacctctgccttctaagtggctgggactataggcacatgccaccatgccaggctaattttttacttttgtagagatgtggttcttgttttgttgcccaggctggtctcaaactcctggcttcaagtaatcctcctgcctcagccccacaaaatgttgggattgcaggcgtgagccaccatgcctggccccaagtactattttagatactgttcttattaaacaaccccttggaggggccttaatcactaccccaggttgcctctaatggcaggcagaacaccaattgtaagtgaaattacagttcttcatggattgaaaagtaccacttacagatatattctttggatcatcactaaaccttgtgatataggaatttatagctggagaaactgagtctcagatttggagaaatgctcaacagcagaggtgaaagtgaaaagcaagaattcaggtctctgggctcctggtgccaaatctttacataactgcacccaaatccatgaaaaacaaaaaaaaatttttttttttttttgagatggagtctcgctctgtcgcccaggctggagtgcagtgacgcaatctcagctcactgcaagctccgcctcccgggttcaggccattctcctgcctcagcctcccgagtagctgagactacaggcgcctgccaccatgcccggctaatttttttatatttttagtagagacggtgtttcaccgtgttagccaggatggtctcgatctcctgacctcgcgatccacccgcctcggcctcccaaagtgctgggattacaggcgtgagccaccgtgcccagtcaaagatattttttaaaaatcagtttcaggtgtttgctttgtaaattgctccctcctgctattttttttttttttcagacagagtctctggagtgcagtggtgtgatttcgactcactacaacctctgatttccgggttcaagcaattctcctgcctcagcctcctgagtagctggtattataggcacgtgacaccacacccagctgatttttgtatttttagtagagacggggtctcaccatgttggccaggctggcctcaaactcctgacctcaagtgatgcacctgctttggcctccaaaagtgctgggattacaggcatgagccactctctcatgttatttttaaatgttaaggaaaaaggagtttacgatttccaagaatcttcacccagttcttctttcaaatctagatacaggccgggtgaggtggctcacgcctgtaatcccagcactttgggaggccaagatggatggatcacctgaggtcaggagtttgagaccaggctggccaacatggtgaaactctgtctctgctaaaaatacaaaaattagctgggtgtggtggctcgcatctgtaatcccagctactcaggaggctgaggcaggagaatcacttgaaccggaggggcggaggttgcagtgagcccatatcaggccactgcactccagcaggggtgacagagtgagacgctgtctcaaaaaaaaaaaaaaaaaaaaaaaacaaacttcaaatctagatataaaaatgtcctctgaaaagcaaaacagtgtacatgtgcacacacactccacagacacccacacatgtaaggtgttagtgtaacatgttaacactgttctggggtgagtgggttgtttgttttaaataatcacactgaaacacacacctcccaagagtgtcgtcctattcagtgtaatcactcacactccactgagtcaactgagcagctaccactgctcaggacttctcccaagcttctttggaatgtcactcacattctctcggacatttctagaacaatattttgtggacctaattggtttttggaaactgccaaaaaccattggtgaaaattggcagaataaggtgggtgataactgttgtgaaatgctgggaaacagggaggggtgtatgagacagagttataaaatagttgggccaatttactggtgtgccatgtaaatcatgcttgaaataactttagaagaatcagcatttggggccaggcccgatggctcatgcctgtaatcccagcactttgggaggctgaggcaggtggatcacttgagaccaggagctcagactcacctgatcaacatggcgaaactccaactctactaaaaatacaaaaattagctgggcatggtggctcacgcctatagtcccagctactcaggaggttgaggcaggagaatcacttgaatctgggaggcagaggttgcagtgagctgagatcacaccactgcactccagcctgggtgacagagcaagattctgtctcaaaaaaagaaaaaaaaatcagcacttggcaagaggattacagatgactagcttttagggcaaacagacatttcccattttggatatgtgtctagcatgattaaaggaggctcactttataaaagcagtagttacattactaaagtttatggccaccatatatacacctacgaatgttccttactattaataaaaataatagaaattgtgtgaactattataataagccccacaagacagaattcaattcaaaaaaattgttttaactatgtttttaacctaagcctattcacttacatttctctgatgttgaaaaatataaaagtctttagtggtttttatcaaaagtcttctggttattcatctatacttataaacaaatctcaaacactttcaatgctttttaaaatcataaaacccaactgagaaatagttagaaagtaatcttcaaaagatacatcacttatcaaacattcttatttatgatttccaaatacattttatcagccatcaaatttcagctaaaggctattttccacctgtttaacatgtggttataggaaatatctcaaaaaaggtagtaaacctataataaaaatcatctgacaagaatgcagggactggcacgcaccagtagtcccggctacttgggagactgaggtgggaggatcgcttgagcccaggagtttgaggctgcagtgagctatgactgcaccactgtactccagcctgggtgacagagcaagacctcaacttaatttaaaaaaaataaaataaaattcagggtctgaatattatgttgttcttgctcaacttttaaccagctggaaactttccagaatcactaattcctagatatacactgctcatgttctcaggaaatgtattttggctcacaagtttgatatttttatcaggtattaaaggaacattatatgtgttattattagtgacacagataattttacaccctaatgagaaaagctgaaatcatatataaagccataactcagattttgaagatatttaggagaggaaatatatatgtgtgcatgtatgtatgtctatacacatgtgcatatacatatatgtacacatatacacacatacacatgtgtgtttatctatacatatttaaagggatttgtaaacaagctgaaaagcggtgagagtcactggcacagcagctatgtgagcacactttagagacagcctgcatggcttacctctgtcaagagtaggcactaatgggctgggtgcagtggttcatgcctgtaatcccagcactttgggaggcccaggccggcggatcacttgaggtcaggagttgaaaccccatctccactaaaaatacaaaattagccaggcgttttggtgggtgcctgtaatcccagctatttggaaggctgagacaggagaatcgcttgaacctgggaggtggaggttgcagtgagccgagatcccaccactgcactccagcctgggcgacagggtgaaactccaactcgaaaaaaaaaaattaataattcctaactccacagagatctaaaaactaattccgtagagatctggcaattgtcagatgcaaagttttaagcccaaagacctttccataaagaagttacctttatggaaaggtaacttccacagtggctcacccctgtaatcccagcactttgggaggccgagacgggtggatcgcctgaggtcaggagtttgagaccagcctggccaacatggtgaaaacctatctctactaaaagtacaaaaattagccaggcgtggtggcaggcgcctgtaatcccagctactcaggaggctgaggcaggagaatcgcttcaacccaggaggtggaggctgcagtgagctgagatcgtgccattgcactccagcctgggtgacaagagcgagactttgtctcaataaaataaaataaaataaaataaaataagttacctttatgaggaggaaaatgccacaaatttctggttatcaggatcattagatgatccctattgataaagacagaatccattaacagtacttagctttacatgcctccagtcataaataccaaaatactttctttaataactataagtcccatatatttacataataggttatagagtgccattttgggtccagtccatgttttgaagggatttataaatacaggtaaaacgtgctgccagacattatttacaacctaaaacaatctttccagctgggcctagtctgttctcagccaccagtaccctcaaccttttttagtcagagtcactagaaagttttttcaccctgaacgtaaacagcagtcaattctccaagtgctcacataacatccttgactttacaggcgagatgacattatggcaactgaagactgaagattggtgttggctacacttcgcaggcacctggcagctaataatattgttgaggttgctgatccactttattccttcatgtccattatttttatgacattacattaaaaataccagattacagatatggtctcactctgtcacccaggctggagtagagtggcacgatcatagcccactgcagcctcgaactcctggcctcaagatatcctcccacctcagcctccttagtagctgggactacaggcgtgtactgctgcacttggctaattttttattttattttattttattttattttatttatttatttatttatttattttttattgatcattcttgggtgtttctcgcagagggggatttggcagggtcataggacaatagtggagggaaggtcagcaggtaaacaagtgaacaaaggtctctggttttcctaggcagaggaccctgcggccttccacagtgtttgtgtccccgggtacttgagattagggagtggtgatgactcttaaccagcatgctgccttcaagcatctgtttaacaaagcacatcttgcaccgcccttaatccatttaaccctgagtggacacagcacatgtttcagagagcacagggttgggggtaaggtcatagatcaacagcatcccaaggcagaagaacttttcttagtacagaacaaaatggagtctcctacgtctacttctttctacacagacacagcaacaatctgatttctctctttccccacatttcccccttttctactcgacaaaaccgccatcgtcatcatggcccattctcaatgagctgttgggtacacctcccagacggggtggcggccgggcagaggggctcctcacttcccagaaggggtggccgggcagaggcgccccccacctcccggacggggcggctggctgggcgggggctgccccccacctcccggacggggcggctgccaggcggagatgctcctcacttcccagacggggcagctgccgggcagagacgctcctcacttcccagacggggcggctgctgggcagaggggctcctcacttctcagacggggcggccgggcagagacgctcctcacctcccagacggggcggcggggcagaggcgctccccacatctcagacgatggcggctgggcagagacgctcctcacttcctagacgggatggcggccgggaagaggcgctcctcacttcccagactgggcggccgggcagaggggctccccacatcccagacgatgggcggccaggcagagacgctcctcacttcctagatgggatggcggccgggaagaggctcctcatttcccagactgggcggccgggcagaggggctcctcgcatcccagacaatgggcggccaggcagagacgctcctcacttcccagacagggtggaggccgggcagaggctgcaatctcagcactttgggaggccaaggcaggcggctgagaggtggaggttgtagcgagccgagatcacgccactgcactccagcctgggcaacattgagcactgagtgaacgagactccgtctgcaatcccagcacctcgggaggccgaggctggcagatcactcgcggttaggagctggagaccagcccggccaacacagcgaaaccccgtctccaccaaaaaaatacgaaaaccagtcaggcgtggtggcgcgcgcctgcagtcgcaggcactgggcaggctgaggcaggagaatcaggcagggaggttgcagtgagccgagatggcggcagtacagtccagcttgggctgggcatcagagggagaccgtggaaagagagggagagggagaccatggaaagagagggagagggagaccgtggaaagagagggagagggagaccgtggaaagagagggggagggggaggtggagggagaggggaggggggagggggagagggggagagggagagggacttttattttatttttgagactgagtttcgctgttgttgcccaggctggagtacaatggtgcgatctcagctcaccgcaacctctgcctcccaggttcaagcaattctcctgcctcagcctcccgagtagctgggactacaggtgtgagccatcatgcccagctaatttttgtatttttagtagagagggtgtttctccatgttggtcaggctggtcttgaactcccgacctcaggtgatctgcccacctcagcctcccaaagtgctgggattacaggcgtgagccaccgcacctggcttaatttattttttgtagagatgaggtcttgctatattggtctcgaacgcctgggctcaagtgatcctcccacataggcctcttttttttttttttttttgagacagaatcttgctctgtcacctagactggagtgcagtggcatgatctcagctcactgcaacctccgtctcccgggttcaagcaattctcctgactcagcctcccaagtagctgggactacaagtgcccgccactacacctggctataatatttgtatttttagtagaaacagggtttcaccatgttggccaggctggtctcgaactcctgtcctcaggtgatctgccagccttggcctcccaaagtgctgggactacaggtgtgagccacagcacctggcttatctcggcctcttaaactgttaggattacacgagtgagccatggctcccagccacaattcaaattttggaaaaccaattatctgccctaattattacgctccagccaaactacccaattttttttttctttttgcattccttccccacaagttactctgtgtcaagtttctaatgttgagtttcatcatttcactgacaacaggcttctaaaacccaggaatacttaagatctattggtatttctttgggtcaaattggtagagctaaagtacattgaagtcattcaaatacattcaaactacacagattccttataaattactggtatcaagaaaggaaaagattcaagaagacattacagaattcatcatatgttatcagaattactgatgtagtctatcctagcatagagtagctttctcaacctattgcataaaaattaccagcaagaaagaatagtacaaaataaggtttatggctaagttggctctgtatcataattatccattctagcattcttagaaggatcctggctgggcccagtggctcacacctgtaatcccagcactttgggaggctgaggcaggtggatcgcttgagctccggagttcaagacaaggctgggcaacatggtgaaacccggtctctaccaaaaatacaaaaaaaaaaaatagcctgacatggtggcatgcgcctgtagtcccacctactcaagaggctgaggtggaaggatcacctgagcctgggaggcagaggttgcagtaagccgagatcatgccactgcactccagcctgggcaacagagtgggaccccacttcaaaaaaaaaaaaaaaaaaaaagaagaagaagaatcccacctgtgataaaggcaataactgcagtcacatttgaatggctcatttcttgactcattctgaactcccttaagtccagtgtctgttagttctttcaagctgagaaaaattgttgagtaagaggtatctgtattaacatcctttctttctgcacagatcacaatcaatgtccttactcctctcctcctgtagggcaagccatctctgatctcctgtaagatctgtcctgctgttggagtgaaccgtctggaagaggggaggggaatttggtaccggggttgagtcaagttactaagatcctttaccaacatttctgagcagacgggatgacaggctgctgaatcttcctgggaattttcttcagtgggcatccgagaagactctggggtcaaggttgggttaagcttttgggatgggtccatcagtggcctagtcacagctctaagctcctcttggatcgttgggtttctatgggtgattctggactctcaaaattctattttgaacactctatccttattctagtcactaataatccagcacagaatattcctgatgaaaagtccatcagggccgggcacgatggctcacacctgtaatcccagcactttaggaggccgaggcgggcagatcacttgaggtcaggagttcgtgagcagcctggccaacatggtaaaactctgtctctactaaaaatacaaaaatcaggtggcacacggtggctcatgcctgtaatcccagaactttggggggccgatgtgggcggattaactgaggtcagaagtttcagaccagcctggccaacatggtgaaactccgtctctactaaaaatacaaaaattagccaggagtggcggcaggcgcctgtaatcccagctacttgggaggctgaggcacgagaatcacttgaaccagagaggcggaggttgcagtgagccaagattgagccactgcactccagcctgggtgacagaagtgtgatcctatctcaaaataaaagaaaaaaaagaattaactgtataacagtaaattaacttgaaaagtcattctggccattgtgtaggaaaaaaactaagaagggccgggtgcggtggctcacacctgtaatcccagcactttggtaggctgaggtgggcagatcacgagatcaggagttcaagaccatcctggccaatatggtgaaaccccatctctactaaaaatacaaccgggtgcggtggcacttgcctgtagtcccagctactcaggaggctgaggcagaagaatcgcttgaacccgggaggtggaggttgcagtaagccaagatcatgccactgcactccagcctgggtgacagagcgagactccatctcgaaaacaacaacaacaaaaactaaaaaggttaaaagcttaggtaagatacaagaacagttaaaaatgaaaaaaaaaaaatctgattatatctagtgctggcaaagcacctggagttttcatttcagtactgcatgtgagtgtaaaccaatccatcgttttggaagactgctgcaacgtctactaaaactgatcaaacacatctcctattacccagaattccattcctaggtatacactaaacaaaatgtgtacacatgttccccaaaggacattttaaaaattcctaggctgggcatgggctcacacctgtaatcccaggactttgggaggccaaggcaggcggatcacctgaggtccggagctcgagacaagcctggccaacatagtgaaaccccctctctactaagaaaataatggctgggtgcggtggctcatgcctgtaaacccagcacttcgggaggccgaggtgggtggatcacgaggtcaggagttcaagaccagcctggccacgatggtgaaaccctatctctactaaaaatacaaaaatttgctgggtgcagtggcaggcacctgtaatcccagctacttgggaggctgaggcaggaaaatcgctcgaacctgggagctggaggctgcagtgagctgagatgacaccattgcactccagcctggataacaagagcaagactgcatctcaaaaaaaaaaaaaaaaaaagaatggatcaattgtagcacattcacataatagaatatcataccatatcattgaaaaactcagctacacacacacacacacacacacacacacacacacgcgaatgaaactcacagtatcaagtaagctggatacaaaagaacatatactgcttaactccatctatatagttacaaaatagacaaactaatctgtggtcatataaatcagtgagtggttatcttggggaagagtggaggttagagactaggacagagcatgaggcttgcagggtaatggcaatggtcatatttcctggatctggctaccattcacatgagtgtgttcactttatgaaaattcaggccggggtggtggctcacgcctgtaatcccagtactttgggaggctgaggcaggtggattgcctgagcaacaaggtgaaaccccatctctactaaaatacaaaaaaattagctgggtgtggcagcgtgcacctgtagtcccagctacttgggaggctgaggcaggagaactgctggaacccgggaggtgaaggttgcagtgagccgagatagcaccactgcactccagtctgggcaacagagtgagactctgtctcaaaaaaaaaaaaaaaaagcaaagaaaattcagagctgtacacatatgacgtatacttttctgtgtaatattttaatttttcaagtatatatatggtagaggccagatgggaagatactgcagtagtctggatgaaggaagatattgggttttttttgttttgtttttgagacagagtctcgctctgttgcctaggctgcagtgaagtggcatgatctcggttcactgcaacttccacctcctcagttcaagcgattctcctgcctcagcctcccgagtagctgggattacaggtgtgcaccaccagtcttggctaatttttgtatttttagtagagatggggtttcaccatgacggccaggctggtcttgaactcctgacctcaagagatctgcctgccttggcctcccaaaggcgtgagccaccatgcctggttagatgttggtttagactagggtaagaagaaccataaagtgatccatttatgttttttgttcgtttccaattttccattttgtaaccactttagtaaatataatacaatcatcagcaaatctaatgtcaaaacgaagcattttcttgaaagagtaaatttcagtaagcctatatatagctgcgaatgaatgtaggtaacttccaggtatattaaaaattaaaactttcgtatttgacagcacaaatagaatcccggtactaatttaagacctaaccagattaggaatacaaaatatacggccaggtgccgtggctcacacctgtaatcctaacactttgaaagaggctgaggtgggtggatcacttgaggtcaggagttcaagaccagcctggccaatatggtgaaaccctatctctactaaaaatacaaaaattagccaggcgtggtgtcaggtgcctgtaatcccagctacttgggaggctgaggcaggagaatcgcttgaacccaggaggcggaggctgcagtgagccgagatcgcataccactgcagtccagcctgggcaacaaagggagactgtgtctaaaaaacaaacaaacaaatagaaacaatatataagccactcaagaaacatttatccttcatgatacaagggcaaactggccaggcatggtggcttacacctgtatttccaacactttgggaggctgagacacgaggactgcttgagcccaggagttcaagactagcctgggcaacatattgagactctgtctctacaaaaaataaataaaagctgggcacgatggtgcacatttgtagtcccagctacttgggaggctgcactgggaggattgcttgggcccagaatatcaaggcagtaatgagccataatcacaccactgcactccagccccccaaaaagggcaaaccaaattctaaataacatactactttaattgtgccttcacatggggaacatcaaacagtcaaatgtcaacactcaaattgcctactgttttcctaggattgctacaagtcttttataatttgtcttattctcacttaaacaattaagaaacttctttctaatccaactagtttatcagcaaatatgctgaagcacaagctgacttcagatgtctgtgctatatatatatatattttttccacttcaagaatctcaactgtgtcacttcccatggctagttccatttttgtctgttatactcagatgttgcctgtccagaaacccagttctgctgtgctagcagcccctcttcctaaaacatggcccaggatcacccacattcttggagtgatatgcagaagtagttatggttcctacctggcacacacccagcacattcccattaggagtgcatcctaatcatctttgttcttgttgttttgagacagggtctcgctctgtcgtccaggctggagtgcagtggcacaaccagggctcactgcagccttgaaatcctgagctcaaacaatcttcccacctcagcctcccaagtagatgggacccacaggggcatgccaccatgcctgggttttttttgttttgtttttgagacagggtctcactacattgtccagactggccttgaactcctggcctcaagcaatcctcccacctcagtttcccaaagtgctggattacaagtgtgagccactgtggccagccctgaccactgctgaaagatgcttggcaaactacattgcatagcagtaatggataacattaactacaaaaaaacctagattttaaaaaatctgtacttttgaaaaaaagaaaaacacctagtttttgtgaaaaatgtgtaaccatggctagtagttttaatctcccaagccaggaagaaaaaagaaatctaggccaattaatttaattttaattacttttttatttatttttgagagggagtctcgctttgttacccaggctggagtgcagtggtgtgatctcagctcattgaaacctccaactccaaggttcaggcaattctcctgcctcagcctctagagtagctgggactgcaggtatgtgccaccatgtccagctaatttttgtatttttagtagagacagggtttcgccattttggccaggctggtcttgaactcctggactcaagtgatctgcttgccttggcctcccaaagtgctgggattacaggcatgagccaccacactcagccaattttttttttttttttttttttttttttttgagacggagtctcgccctgttgcccaggctggagtgcagtgacacaatctcagctcactgcaaactccacctcccagattcaagcaattcttccatctgtctcccgagtagctgggattacaggcatacaccatcatgcctggctagttttttgtattttcagtagagacggggtttcaccatgttggccaggctggtctcgaactcctgacctcaggtgatccacccacctcggcctcccaaagtgctggaattacaggtgtgagccaccacgctcggccccgatttatttatttattttttgagacagagtctcgctctgttgctcaggctgaagtacagtggcacaatctcagctcactgcaacctctgcctctcaggttcaagcaattgtcgtgcctcagcctcccgagtagctgggactacaggcatgcaccactatgctcagctaatttttgtatcttcagtagagatgcggttgtgccatgttggccaggcaggtatcgaactcctggcttcaagtgatccacctgcctcggcctccgtaagtgctgggatttcaggcgtgagccaccggcgccccgccaggccaattaattttatttcagactaccttcacccacaactgcagagtctcagaatctaccttttcacaagcaccccaccaattctgatcaagttctactcaaatagaacacgaggtaatgttctggtttcaagagggagactaaataaaatacatgtttactttcatttcctcttatcatattaatgtatttaacatttactgaacacctaccacatgccaagaactgttacaagtactagaatttgtgtagttaacaaaccaagtccctgccttcggggagcttcaaccaaggaatgaagttatccatttttaaaaaataaaatatatccctgggtataagaaatgtggattttaaaggacatcctaatccctgtcattttactgaaaatgctcaaaggcaactattgtaaaacaggaccatttgcccaacattctaatacacaagtagaacccatattgctaaataaaaacataccttaaaggaaattgaaaacaaactatcagggccatctatcagcaaacatgttggtaatatttcattttcaataggctggtaagtctcctggtaagtcttctagtcttgataaagtgtacacagtcttaaaccaggaacatattacatatcaacaccccacccgattatccattcatggcttactacacctgcccagaattgtctagtctcaggttaatgtgctcctgaatcaaggacttatccctccttcatcatccttcgtcactttttccccaatctgaacccttattaaacaaagtatgagttatgccatctgctaaaatataacctagccagagaaaattaaaaatgtttttcaagtttagtcctcttcaaaaagtagcaagctaagatgattaaatgtgtagtctcattttttaaaaagctgttaagacttacacattagctttatttttgtgagcaaaagcaatcgtacaaacccaatatggaacaactcaattcttaacttgtaaccagtaaagtgaactgaatgtgaaaacctgaaatttatacaataattctcagaacatgcacagttgcatatggctacgtatttcatgctttattttgtctagatggtttcagacttctctttgctggtataccaaaacgtaaggaagaaagataaaggaccaggaaaaaaaattacacttgggcaagttatggtatctgctgattttatacagcaaaatctggtttaccttaacaatgctgtaattctatagcaccatgacaaccaggctttttgcaaaactcttgtcagttcccaagaaggaaggaaagtgaaaagaggagacccacgggcaagctaagcctcgctggaagatcaacaactggacagctcactcctgagattcctttccagcatacagtcgccctggctttcctcaaacgctatccaaaagcacttcagtttgattcatgtttgcaaactttccaagctgactccaagacgttattagatgtggatcactcccagaggaacatctcagagaaacaatggttagtgaattctttaaagtgcaataaattggaacagacaaaattcggcatatgtattttgagttggaaagttaaggaaataatttattgaacatacttcttttgtccgctgttactctgatattcttgtttaaaaaccaagccatcaaagttatgtagatcatgtctctctcttcccccaaacaaa

SEQ ID NO: 39 - DNA, 134400 bp, Artificial Sequence
  Synthetic BAC sequence
gcttcaagtttatgactaacaatttacaaatactttcttgttaatatttttaacttaacttgacctagagaatgacaaccatgggaaataagtcagatatttttctcattttacaaataaaaacctgaagctaaaatgctgaaattgttccccaaagtcattgacaagcagcagagccaggaggcaggagcagggtcttggattaggtttgagtgcaagaaatagggtggtgccggcattcataccacagggctctgggtgtcatcgtgggcctacctgggactgcctccgtgattttaaggaattgtttaatttccctcaggaccgtttcttggataataaacagggaacaataggccatgtcaatcatgtaaagttgttgtaaagataagggaaggccgggcatgatggtgcatgcctataatcccaacactttgggagaccaaggcgagaggatcactagagcccaggagtagaaggttgcagtgagctatgactgtaccactgcactccagcctgggtgacagagcgaggctcacacttactgaacatctaccacagaccaagcactgttccaccatcttgaatctattgactcattgactcatccaaccaccctacaagttatatcaagttatatcctccctattttcaagatgatgaaattaggaaaagttaagtaatttctccaacaatgcatatccttagcctggattctccagagagccaagagggaggaagggagggtgggatccgccccaagctggttatcactaaatgcatcttcttgacctggtcagactgtccgcctagaagcttcttaaggtgtgactaatgactgtgagtctggggcaggaggatgcctgggtatgagcgctgagtagggtccccaggaagccccagggcagaagataagaggagcccaagtgagcctgaggcggggcacggccaggctgactgctggagtcagtgggagtctgtgcagagctggtcgccacctctgaggctggcacaagagacaggcgaactcgaaaaagcatgcagtcgggcaaagtcgggtatgttacaagcctacgatgtcatggggctagtctttctctccttgtgtgaaagacgtggttcccattcctgaccaaccacagggaggcatgcattgtgagctagttagctcctggtgggaacaggcttacacaaatccacacatatgttctgttccagtctacggccaatgcctgtcttggaggaagaaacgacccaagtacagggaagctgcagctttctgctcaggactgccagcatgtggagcttccaggtctagggtggatgagacacatccccagggaactccctctggctagatgattgaagatgttaacgatgcatatagttgcacccagccatgctcaccaggggagaaaaatgctgctgcccccaccaagcaagggtctttcaaggagctcctagtcaggcttgtgttttcaaatctgacacacacaaacacacacacacacacacacacacacacacacaaaggccaggcacaatggcttctgcctgtaatcccagcactttggggaggctgaggtaggtggatcacttgaggtcaggagttcaagaccaacctggccaacatggtgaaaccgcatctctactgaaaatacaaaaattagccaggcatggtggcaggcgcccataatcccagctacttaggaggctgaggcaggagaattacttgaacctgggaggcagaggttgaactgagccaagattgccctactgcactccagcctgggggacagggcaagactccttctcaaaaaaaaaaaaagaaaagaaaaagtttagttctttgattatacaagtaaatacttctccattaaaagtaatttatactgttgtagaaaaattggaggtataaatacacttagaagtttgaagagctcatcttccctggtctatgtcctctgctcctggagacccagcctctgtggccctgtgacctgcaggtattgggagatccccagctagacgtcatgtcccctgagatgcctagaaatggtctcttcccagggtgagagaggaatgaaaacttaaaggaaagaaactctgggcttccaagatggccaaataggaacagctccagtctgcagctcccagcgtgatcgatgcagaagatgggtgatttctgcatttccaactgacgtacctggttcatctcactgggactgtttggacagtgggtgcagcccacggagggcaagctgaagcagggcggggaatcacctcacctgggaagcacaaggggtcaggggatttccctttcatagccgatggaagccatgacagactacctggaaaaacggggcactcctgcccaaatactgtgcttttcccaaggtcttagcaatgggcagacaaggcaattctctcccgtgcctggctcggcaggtcccatgctcatggagccttgctcactgctagcgtagcagtctgagatccatctcctatgcctggctgggggaggggcatctgtcattgctgaggcttgagtaggtaaacaaagtggctctgaagctcaaactaggcagagcccactgcagctcaacaaggcccactgcctctagacttcacctctgtgggcagggcatagctgaacaaaaggcagcagacaacttcttcagacttaaacgtccctgtctgacagctctgaagagagcagtggttcccccagcacagcgcttgagctctgagaacagacagactgcctcctcaagtgggtccctgacctccgtgtagcctaactgggagacacctcccagtaggggccaacagacacctcatatagggggctgccccttagggacgaagcttccagaggaaggatcaggcagcaatatttactgttctgcaatatttgctgttctgcagcctccacttgtgatacccaggaaaacagtgtctggagtggacctccagcaaattccaacagatctgcagctgagggacctgatagttagaaggaaaactaacaaacagaaaggaatagcatcaacatcaacaaaaaggtcatctacacaaaaaccccatctgtaggtcaccaatctcaaagaccaaaggtagataaaaccacaaagatggggagaaaccagagcagaaaagctgaaaattctaaaaatcagagtgcctcttctccaaaggattgcagctccttgccagcaacggaacaaagctggacagagaatgactttgacgagttgacagaagtaggcttcagaaggtcggtaataacaaacttctccgagctaaaggaggatgttcgaacccattgcaaggaagctaaaaaccttgaaaaaagattagatgaatggctaactagaataaacagtgtagagaagtccttaaatgacctgatggagctgaaaaccatcacaagcttcaatagccaattcaatcaagtggaagaaacggtaccagtgattgaagatcaaattaatgaaataaagtgagaagacaaggttagagataaaagagtaaaaagaaatgaacaaagcctccaagaaatacgggactatgtgaaaagaccaaatctgtttgattggtgtacctgaaagtgatggggagaatggaaccaagttggaaaacactcttcaggatattatccaggagaacttctccaacctagaaaggcaggctaatattcaaattcaagaaatacagagaacatcacaaagatactcctcgagaagagcaaccctaagacacataattgtcagattcaccaaggttgaaatgaaggaaaaagtcttaaaggcagccggagagaaaggtcgagttacccacaaagggaagcccatcagactaacagcagatctctcggcagaaacctgacaagtcagaagagagtgggggccaatattcaatattcttaaagaaaagaattttcaacccagaatttcatatccagccaaactaagcttcataagtgaaggagaaataaaatcatttacagacaaaaaaatgctgagagattttgtaaccaccaggcctgccttacaagagctcctgaaggaagcactaaacatgaaaggaaacaaccagtaccagccactgcaaaaacataacaaattgtaaagaccatcgatgctaggaagaaactgcatcaattaacgggcaaaataaccagtgaacatcataatgacaggatcaaattcacacataacaatattaaccttaaatgtaaatgggctaaatgccccaattaaaagacacagattggcaaattggataaagagtcaagacccatcagtgcactgtattcaggagacccatctcaggagcaaagatgcacataggctcaaaataaagggatggaggaagatctaccaagcaaatggaaaacaaaaaaaaaagcaggggttgcaatcctagtctctgataaaacagactttaaaccaacaaagatcaacagagacaaagaaggccattacataatgttaaagggatcaattcaacaagaagagctaactatcataaatatatatgcacccaatacaggagtatccagattcataaagcaagtccttaaagacctacaaagagacttaggctcccacacaataataatgggagactttaacaccccactgtcagtattagacagatcaatgagacagaaggctaaaaaggatatccaggacttgaactcagctctgcaacaagcagacctaatagacatctacagaactctccaccccaaatcaacagaatatacattcttctcagcaccacattgcacttattctaaaattgacaacataattggaagtaaagcactcctcagcaaatgtaaaagaacagaaatcacaacaaactgtctctcagatcacagtgcaatcaaactagaactcaggattaagaaactcgctcaaaaccacacaactacatggaaactgaacaacttgctcctgagtgactactggttaaataatgaaatgaaggcagaaacaaagatgttctttgagaccaatgagaacaaagacacaatgtaccagaatctctggggcacatttaaagcagtgtgtagagggaaatttatagcactaagtcccacaagagaaagcaggatagatctaaaattgacaccctaacatcacagttaaaagaactagagaagcaagagcaaacacattcaaaagctagcagaaggcaagaaataactaagatcagagcagaactgaaagagatagagacacacaaaaaaaaacccttcaaaaaaccaatgaatccaggagatggttttttgaaaagatcaacaaaattgatagaccactagcaaaactaataaagaagaaaagagagaagaatcaaatacactcaataaaaaatgatcccacagaaatacaaactaccatcagagaatactataaacacctctatgtaaataaactagaaaatctagaagaaatggataaattcctggacacatacaccctcccaagactaaaccaggaagaagctgaatctctgaatagaccaatagcaggttctgaaattgaggcaataattaatagtctaccaaccaaaaacagtccaggaccaggtggattcacagcagaattctaccagaggtacagaggggagctggcaccattccttctgaaactattccaatcagtagaaaaagagggaatcctccctaactcattttatgaggccaacatcatcctgataccaaagcctggcagagacacaacaaaaaaagagaattttagaccaatattcctgatgaacattgctgagaaaatcctcagtaaaatactggcaaactgaattcagcagcacataaaagagcttatccaccacgatcaagtcagcttcatccctgggatgcaaggctggttcaacatatgcaaatcaataaacataatccatcacataaacagaaccaatgacaaaaaccacatgattatctcaatagatacagaaaaggcctttgacaaaattcaacagccctacatgctaaaaactctcaataaactaggtattgatggaacgtatctcaaaataataagagctatttatgacaaacccacagcgaatattataatgaaagggcaaaaactggaagccttccatttgaaaacaggcacaagacaaggatgccctctctcaccactcctattcaacatagtgttggaagttctggccagggcaatcaggcaagagaaagaaataaagggtattcaattaggaaatgaggaagtcaaattgtctctgtttgcagatgacaggattgtatatttacaaaactccatcatctcagcccaaaatctccttaagctgataagcaacttcagcaaagtctcaggatacaaaatcaatgtgcaaaaatcacaagcattcctatacaccaataacagacaaacagagagccaaatcatgagtgaactcacattcacaatagctgcaaagagaataaaatacctaggaatccaacttacaagggatgtgaaggacctcttcaaggagagctacaaaccactgctcaatgaaataaaacaggacacaaacaaagggaagaacattccatgctcatggataggaagaatcaatatgaaaatggccatactgcccaaaataatttatagattcaatgccatccccatcaagctaccaatgactttcttcacagaactggaaaaaactactttaaagttcatatggaaccaaaaaagagcccgtattgccaagacaattctaagaaaaaagaaaaaagctggaggcatcatgctacctgacttcaaactatactacaaggctacagtaaccaaaacagcatggtactggtaccaaaacagatatatagaccaatggaacagaacagagccctcagaaataacaccacacatttacaaccatccgatctttgacaaacctgacaaaaacaagaaatggggaaaggattccctatttaatcaatggtgctgggaaaactggctagccatatgtagaaagctgaaactggatcccttccttacaccttattcaaaaattaattcaagatagattaaagacttaaatgttagacctaaaaccataaaaaccctagaagaaaacctaggcaataccattctggacataggcatgggcaaggacttcatgtctaaaacaccaaaagcaatggctacaaagccaaaattgacaaatgggatctaattaaactaaagagcttctgcacagcaaaagaaactaccatcagagtgaacaggcaacccacagaatgggaaaaaaattttgcaatctacccatctgacaaagggctaatatccagaatctacaaagaactcaaacaaatttacaagaaaaaaacaaacaaccccatcaaaaagtgggcaaagcatatgaacagacacttctcaaaagaagacatctatgcagccaacagacaaatgacaaaatgctcatcattaatggtcatcagagaaatgcaaatcaaaaccacaatgagataccatctcacaccagttggaatggcaatcactaaaaagtcaggaaacaacagatgctggagaggatgtggagaaatgggaacacttttacactgttggtgggagtgtaaactagttcaatcattgtggaagacagtgtagcaattcctcaaggatctagaactagaattactatttgcccctccaatcccattaccgcatatatacccaaaggattataaatcatgctactataaagacagatgcacacatatgtctattgcggcactattcataatagcaaagacttggaaccaacccaaatgtccatcagtgatagaatggattaagaaaatgtggcacatatacaccacagaatactatgcagccataaaaaaggatgagttcctgtcctttgcagggacatggatgaagctggaaaccatcattctcagcaaactatcacaaggacagaaaaccaaacaccgcatgttctcactcataggtgggaattgaacaatgagatcacttggacacagggcagagaacatcacacaccagggcctgtcggggggtggggggctgggggagggataacattaggagaaatacctaatggaaatgatgagttgatgggtgcagcaaaccaacatggcacatgtatatctatgtatcaaacctgcacgttgtgcacatgtaccctagaacttgaagtataaaaaaagaaattagaaaaaaaagataatatgacaggctaggaagaaaggcaggtggaaaattattgtctaatgagcacaaagcttttgtttagaatcatgaaaagtttctggaaacagataatggcatggttatacaacactgtgaatgtatttactgccaccgaattgtacaattaaaatggttaaaatagtttttaaaaaaaagtttgaagaagagaactattatcacctaaaatctctcttctccccaagataaccacactaacattttggtgtattcctttccaggcctttctttgtagacatataaatataaactgcatttttaaataaaatggagttgatgatacaagtgttttattactctgctttgttctcttaacattttatgataaatattttattgccattaagaatgcttccaaaacacattatttatagctgaacaatattttttggatattcgggctgtttataatttttcactctgatatatggtgctgggatgaagagccttaaacagaagtctttgatcacatttctgattacttcctttagaagacacttaaaagtagaattactgggacaaatgatataaatattttaatgaaaatttttattgccaaatagtttccagaaattgaccaatttacagttctatctgcatctgtcagtgcagacacattgcaaaaacaagtcagtattttaaatgcttttcagagtagcaggaggaaatggtatttcattttttttgactcctatttctttgattaatggttctattgaccaattcttaatttgttgaccgtttggatttcttcttttaagaactgcttgttcattttctttgataatttttaagttggtatgttagtattttttattgactggatataattaggagctgcttatttgtcatgctcattgcaaatatttttgcctgttttcattttactttttacaattttttacaattttttatttttaaaggccagtcaaatttagcagtgggtgtcattttgcttttaacttgtattatacagggattttgtaaatatagctggtttggggacttttctttgttttacatggttaaatctaacaagagttacctttgtgattcctcccatgatctcatgcttataaagttctctccatcccaagatcagttacacatgctcttattttcttctagataattaagaaaagatatgaaatcacaacacattagtattggaagagttggcgaagtccttcatttcacagatgaagaaacttaggcttaaggggtaaagtaactcaaaaaccagatcacgcagccattaagtggaaaagccaagattttcctttcgattgaggtataattagcacacaataagatgcacaccgtctcaagtcatcagttcgatgggttttgataattgctgacgctcttgtaatcaccacccaaatcaagatacagaatatttccaccaccatcagcaaccactatctgagatctttcactatagggtattttgtctagatttggattttataaaaacggaatcataaagtactttttagtgaatgtcttcattcacttagcataatatgtttgagattcaaccatgctgttgtgtctatcagcagctaattcgttttttattcctgcgtaggatttgtatgaatctactatactatgaatgtactatatatacaaatataatataatatgtttatccatccccctgtttaggaacacttggttgtttccaatttggggctattatgaaaaaggcttatatgaataagtattttttggacatgttatttcatttcactcgggagtgaaattgctggggcactgaatggatgcatgtttaactttataacaaagtagggctaaggtttactatctgaccctagagaccatgccctaagccactggacacactgtccctcacagacccaagcactgagagatcaagtttaaatcccagctattctctgtccttgctgtgaacactttggcaagttccttaacctctcagtgcctggtttcctcatcggcaccaccgtcccactccacctcccaggggttgttgtgaaaactaaaagagttaatacaaataaagccctcagaatgagatcttgcaagtggttggtttattattatgaagaatgtctctacatttagtttgtcagatactggactgagagaatggttctcttgaaagtaaccaggaaaggcctccctgtgatggaggggccaccctttaagactgcttgcagcagaatgctatcccttcccacaaagtcagctgggcctgccataactgtcccagtgctccagtgtgctgcctcaagtgcccctgctgcctctgcagtgctcattctccaggtcttgttcttgtccttgtggggttcagcatacacagctctcttgatcagaaggtggccccagccagtccctgaggactcactgcttttaaatactccttaacacctgagcaggatcccacacgctgctctacctctcctccttaggggctaaccaaattgcacaagactccattggctgtggttaatccctgatgtcccagcttgcagtccgtctgcaggcaggtcttcggagggaacgcatttgcaccctggtgtagtactgctaggactggatggcagagcacctttccaaacctgagtgcagttgtccctcagaatccatgggggattggttcaagaaccccaagattacccaaatccatggatgctcaagcctcaagttttggatatcaaatggcctgcaacctaggcacatcctcctgtaaactgtaaaaatacctaatacaaagcctacacatcatttagtgtgcatgaaatccacatacttctcagcatgcaacaaaaattcaagttttgccttttgcaactgtgaaatgttctttcccaaatatttcagtcctcggttggtggaatccatggatgcaaaagccatgaatatggagggttgacagtacttcctaattccttctagaatatcacctacttctgcccttcctccatgccaatctttcccactggatgagaagctccataagggcagagtctaagaaaacttcatgcatggggcccaggcacatcattagtcaggccttcagtaagcattgtcgatggataaggcaaaaatacatttatgtataagcattcaatgcctatcttctcctctcaccctcagaggagatttctgccttctctcatagttcagtttctgggcttttattgaaaagatcagaaaagggttgaaaagaagaacagagctcagagatgctttttagatttctttggaaaatagaagcaaactattaatccaccaacaggagtacttatcatttataattatggctatgcatataatagagtatatagtgaaaatgcaaaatctaacacacacttatccatggactctatccgtgcacttatcaacatgcataaatcatgcaaagttcagttcttaaaatctggagagtgattcatgcatacatatatgtgataccatttaaataaaatttgaaaaatgcaaaatgttgctattattactatgatacctagttatgaatacatactatgtagaaatagtacaaaaacgtatataaaatagcgtgagagtgataaacaccaaattcaggaggaaggttatctaagttgggaccaaattatgtagataaattatttgtgaagaataactgaaagttttggagccacaactgacttgatcagagttgcagtttaggaaggtaaatcttacaagagaaatggaggaaaagttgattcattcaatatttatcaagagtccattatcagccagttgcagtgactcacacctgtaatcccaatgctttgggaggctaaggcaggaggatcaattgagccaggagattgagaccagcctggacaaatggtgagactccatctctataaaaacattaaaaaattagccaggcatgctagcatgtacctgtggtcctagccactcaggaagctgaaagaggattgcttgagccgaagagttcaaggctgcagtgaacgatgatcacgccactgcatactgcactccagcctgggcgacagagtgagacaccatctcaaaaaaaaaagaaagaaacagaaaaatccatgatgtgtcaaacacttgttacaggcacttgtgaatggatagaaacccctgccctcggttgcattctttctgctttctagccctaaggcaataaagcctgtttcacagctgcatctagtgagggcctagaacctcaggattggaaatgaggaggatagactacccaggtagaaggcacagcctgctcaaatatgcaaggcactgcatcaggtatgaaaatgaggtttggcatctcggtggcctgaaaaaatgggtgtccctgggtgaaaccaggaacatggaagtgagacagaatgagcacttgttatgtgcccagccctgcagcagggcccaagcactgcggaggtggatgtcatgttccctgccccgaagcagctcaaattatttctgacaaccattcattcagcagttcattcagcaaatactttctgaataagtgtgcggaaatctgtactgggtaactgtcatcctagcaacctagcaagaatgtgatctatggccccacagcagaatgtggctgtggtttgggggggtctggtgcaaaggtgagaggtaccctgactccaggcaggaaggagagtgagagagttacgatgtgcacttgtctctcacccagttcaagaacctgctcctctcctccttaaacactgttcattcccaggtcctggtccctcactggctcagcctccagacccgcagaccacagccataactctccaaactcaaaacatccactcaggggagataaatctccgcttatggaaggactttctctgggaaggagggtcagaaaggccgcctgaggcagctgaccgctcctgtgggctgaatgtcagtctggcgaagcagaaaacatctgtcagtgagtcagagacctgggtttcagtctcagctctgcactaaaagctgggggaccttgtgcaaccgcttcccctctctgggcctccgcttcttcattggtatgaaggcacacttagatctcttggggccactcctgctataacgattgtgtttcgtttttgagggctgctgtaacaaagtaccatgagccgggttgcttagagcaagaaatacgttttgtgtaatcgctctggaagtgaatagcctaagagaaagatgacagcaaagctaattccttctcaggattgtgcgggagaatctgtttcttgtttctgtcctggcttctcctggtttgctggcatactttggtgtttcctggcttagggacacatcacccggatttctgtcttgatgtccacatcatgttctccctgtatgtatgtgtgttgtatgtgcgtggaaggcgggggtggtgtctctaacttttttgggtttttttgagacagtcttgctctgtcacccaggctggagtgcatgcagtagcttgatctcggctcactgcaacctccacctcccaggtccaagcgattctcccatctcagcctcctgagtagctgggaccacaggtgtgcaccaccatgcccagctaatttttgtggtttttttactagagatggggtttcaacatgttgcccaggccagtccccaactactggccttaagtgattcacttgccttaacctccgaaattgctgggattacaggagtgagccaccacacccagcccggcgttcttcttataggatatcagccatattggatcggggcccaccctacctactccagtatgacctaatcctaactcattatacctacacctatttccaaataaggtcatattctgaggtactgtgggttaggagatcaacacacatattttgtaggggggcacaatttaacccataatgaccatcctgaccttttaattcctcctcccaggaatctgtagggtgactgtaacatttatcattcaaacaggggattttgagaatgaaaaggggaactactaacaattgtggcaaatgacaggtgtcactggggactggcccaggtgagcaggtatgctggtcccctcaggggcctgggggatctaccggggccaaacacgagggtggttgcagggcccagggctgcttccaccacccacggggtcatggtgtgacccagaggaaaactacatcatctctcaaaatgagaacggacggagtgaggggagagacagtgcctggggaagcgccaagggacacgaagaggctggtgctggcatgtggcacctggagtttagttggagaaaagtcaccattttcaagcagtagtgcttcctgatgtgtgagtatggccgcaagcccgggtgggacatgcacagtgtatgtgggactataggatgcatggagaagccctgcatctatctacacagagcgtttaatccatcctgggggacactgattcacgtgaatgattagagggcatccttatgctcagtggagaggaactgggctccttagtgcaatcaaagttcggaaaagaaggtattcagctgggcgcggtggctcatgcctgtaatctcagcacttggggaggccaaggtgggtggatcacgcggtcaggagttcaagaccagcctggccaacatggtgaaaccccatctctactaaaaatataaaaattagctgggtgtggttgcatgcccctgtaatctcatctactcaggaggctaaggcaggagaattacttgaacctgggaggcagaggtggcagtgagccgagatcacaccactgcactctagcctgggcagcagagcgagactctgtcctcacaaaaacaaagaaaaaaaaaagaaaaagaagcatttgagtgctgtaaagtaattgggagatttgtgctcacaaaggtcacttgagagcagaggaacgaaagtccagtcgtgtaagggacagtgaccagagtagcctgagtaaatacggccttgaaagatgaactgagaaactctcctcccatctctatttcctatattctcatgggatcagcataatttcttccttaaacatctggtaatactctttagtgaagccacctgggcctgcagtactctttgtgggaaggttttagattattaattcaatctctttcattgatgcgagtcaattccatattttcacttcttcctgagtcagttttgataaatgggtcattttagtggacttgttcttttcatctagggtatcaaatttattggcatataattttttcaaaatagtattttattaatgcctttaggatccttatgatgtcctagatacagtaaagatatggcacagccatgtaccacataaagtttcagtcaacaatggactgcatatgcaatgataatcccataagagtaaaatggagctgaagaattctgatcacctagtgaagttgtagccatcataacattgtaatgcaattactttattttttaataaatttagtgtagcctaggtttacagtatttataaaatctatggaagtgtacagtaatgtcctcagccttctgaatagtccattctcacactgctgtaaagaaatacctgagacttcataatttataaataaaagaggttgaattggctcacagttccacagcctgcagaggaagcatagcagcttttgcttctggggagacctcaggaaacttacaatcatggcagaaggggaaacacccacctcacatggcagaggcaggaggaaaacagaggtgggggcaggtgccacacacttttaaacaaccagacctcttaagaatactatgatgagaacagcaccggcggatggtgctaaaccattagaaacctcccccatgttccaatcacctcccaccaggccccacttccagtactgggaattggacataagatttgtgtggagacacaaatccaaaccatgtcaccttcacattcactcaccacttactcgctgattcaccagagcaactttccgtctcacaaactccgttcacagtaagtgtcctgtacaggtctaccacttttgatcttttgcactgtagttttactttatcctttctatgtatagacatacaaaaactactgtgttataataggatctaccatatagcctaagtgtgtagtaggctgtaccatctaggtttgcgtacgtgcactccatgatgtttgcacactgataaaatcacctaatgacacatttctcagaatgtaacctgttgttcagtgaagcatgaccactgtcatacatgtgatctgtcactgactgaaatgttatttggtctgtgatgatattgtaaatctcacaaagtattattataaaagagtcaacaatcttttaaagaaattcaaaaatgaaggaaagtatctcttatatttaatcaaatattttctgtttctggcacttttcattcctttgtgtatctaatgtctctctatctggtatcaccttaattctgtgttaagaacatcttttagcatttctagtaaggtaggcctcttggataaaaattctctcagcttttgtttgtctaaaaagtcttcacatcacttttcttagttttggaagacacttttgcttggaatagaatttttggtcaacaagcttcttttcttccctccctgctcttcaaagacatcacttcattgtgtctgacttgcatagtttccaacaagaaaacagcctcaaattttatatttgctccccaatacataatgtgtctctttttttttgctggctgggttgcttttttaaattttcattagttcacgtttgcagcaatttggttatgatgtgccctcgggtgcttttctttgtattttcctacttgaaattctcagagctttttgaattggtgtctttccagtttttataaatttgagcagtctttagccatcatttcttcaaatatttattctgcccccttttctgggactcgaattacttgtatattgaccaactgatattgtccaatgtgtcacaaaactctgttcattttttcctagcaattcaccattttttttttttttgagacgaagtcttgctctgttgcccaggctggagtgcagtagtgcagtctcagctcactgcaacctccacctcccaggttcaagcgattctcctgcttcagcctccctagtagctagtattacaggcacctgccaccatgcctagctaatttttgtatatttagtagagaaggggtttcaccatgctggccaggctggtctcgaactcctgacctcaggtgatctgcccacctcagcctccaaaagtgctgggattacaaacatgagccaccacacctggtaaattttttatcttaattgagcatttctatgattctatcttctttcctttcttggcgtatcagttatacttctcctaccttttttcagtcattgacctagaatttgcaatatacatttagaactaacccaagcccactttcaaataacaatatacagcctcatgggtagtgtgagtacattataataacaaaataaccgaaaatcctctttttattccttgtgtcattgctgtcattcatttcatttatatgtaagcatatgtaagtgtgaatatataagtatatttgtcacaagcatatatttatatatgtattcagttataaatcttatgtatatatcttatgtacataattgaaggtgcagttgctattattattttgaacaaactgttatgtgttagatcaactaagaataagaaaaataggccaggtatggtggctcacatctgtaatcctaatactttgggaggctgaggcaggagaattgcttgagcccaggagtttgagaccagcctggtcaacataatgagaacccacctctatatttagaataataataatctaaaaaagaaaaaaattaatgataagaagaataaacatttttatattgatgttcttcctttctttatgcagatctaaatttctgacctgtactattttccctctctctaaagaacttcttttaacatttcttacaaggcagatctactggcaaagaaattccctcagtttttgtttgattgagaatgtctttttttttttcttcacttttgaaggataatttcacagggtacagcattctaggctggcggggggttttctcccaaacctttaactatttcactacattcccatcttgcttgcatggtttctgaggagaagttggatgcaattcttagctttgcatctctctagcttagctggtttttccttctgtcttctttcaggatatttttctttatctttggttttccgtaatttgaaaatgacatgtctaggtgtagttgttttggcatttatcctgcttgatattctctgagcttcctggatctgtggtttggtgtttgacattaattttggaaaattattggtcattattatttcaaacatttcttctgtttcctttctctttttattctccttctggtattccgttacatgtatgttacaccttttgtaagtgtctcacagttctgtttcttttttcagtctctgttctctttgcttttcagttttagaggtttctattgatctacccacaagctcagagattctttcctcagccatgtccagtccactaagaattctatcaaaggacttgtccattcttcctttctctcacagtattattgatctctagcatttccttttggttttccccttaggatttccatctctctgcttatattacctatctgttctggcatgctgtctactctatccattatggcccttagcatattaataggagttgttttaaatctcctgtcctaattctaatatccctgccatgtctggttctaatgcttgctctgtctcttcaaactgtgtcttttgttctttagtatgccttgtaattttttcttcacagctagacatgatgtagtgggttaaaggaaatgcagtaaatagacccttagtaatgtggtggtaaagtgtatggggggaataagcattccatatttctatgatgaggtttctgtctcttagtgactctgtgcctctggactgtgaacttctcaatttttctccaccttaggttgggcaggatggctagagtagctgaacttgggttatttcccctctcctacatagaaggatagagctggctggatttgggcatttcctccttccctcccaggtcattaggctctgataaaattccagcaggttagactctagttaactaatttctcccgacagcagaccttgttaagacagagtgttctggcatatttcaaaatggctcctttctctctcccatcctgctgaaagcatgaggagatttttctccagtatttactgtgagaacctggttgatatcctgaagacaaaactcacataagtgttgggggcctcctaagactgggtctccctagagcttttaagtctcagatttgtccacgcctagactccatcagcttgtcagttacagttccggttctcccaggcagcagtggttcctgcagaggttgctgctctaatgtactatgattctctgtatttgcttgtctgtctgtttaatttagggggcagtagtttgccctatgacatcatttctcttatgcatctaagaagagtggttgatttttcagtttgttcagctcttattgttaggacacagtggcaacttctaagttccttatatggaggacagaaagccaggagttgcatttttcatttcagatattatatttttccactctagaatttctgtttggtttttttatatcttccatttctctctccattatcttcatattttccactagatttttgagcatatttataatggatgttttttaaataaatttttattttagaataattttagatttgtaggaaagttgcaaaggcagtataaagttactgtacacccttccttagattcccttaatgttaatatcttgcataactctggtacatctgttaaaagtatgtgttgtggctgagcacagtggctcacgcctgtaatcccagcactttgggaggccgaggcgggcagatcacttgaggtcaggagttcgagatcagcctggccaacattgtgaaaccccatctctattaaaaatacaaaaattagctggacgtggtggcacacatctgtagtcccagctacttgggaggctgaggcgggagaatcgcttgaacccaggaggtagaggttgcagtgactcaccactgcactctagcctgggcgatagagtgagaccctgtctagaaaaaaaaagaaaaagaaaaaaaagtatgtgttgtgagttaaactgaactccccaaaaaaggtattgaagtcctaacccctggtacctgtgaatgtgaccttacttgcaaatagggtttttgcagatgtagttaggttaagatgaggtcatactagagtacagtggaccctaactccagtatgacaggaatccttataagaagagacacacaaggagaaggccgtgttatgaaggaggtggagactggagtgatgcatctacaagccaaggaatcccagggtttgccagtgaccaccagaaggcagagagaggcgggaatggtttctccctaaagcccttcagaaaaagcacctccctgccaacatcttcctatcagactcaaggctccagaactgtgagaaatgaaattctattattttaaggcaccctgtttgtgatactttgttacacggtcctagaaaactaatacaaggaaaatactaacattggtacattactatacaccaaactccaaactttgttcagctttcaccacttttccccctaatgtcctttttctgttctggaatccaatccaggagacagtgttgcatttagacactgcatttctcctgtctcctctggactgggacactttccaaactttgttttccatgatcttaaaagtactggtcagcattttgtacgtgtttcccagttagagtttctttgatatttttcctcatattaggctagagatatatggggttgttctttttttttttttttttaaataccagacaggtgaagtgccctctcataacatcatataggggataaatgatattagccagatatatcagcagggatataaaccttgatcaattggtgaagatcgtatctgtcagatctctggctgtgaagttaccatttttccccttccatcctctattctttgcaagtgagtcactaagtccagtcacactcaagcagatggaaatagggaaaattaaattacttttctgctaattccacatgtctgtcatttctgggcttatttcttttgagtaattttttctctcctggctatgggttacattttcctgcttctttgcaaatctagtaattttgtgaatgttacattcttgagtgttagattttgttgcatttctttcaagagtgttgcactttattctggctttcaggtgagttattcagacatcagttgaatagtttgggctttaaaaaaaaagaaaacctttttatcaggcaggagatctagagaagtgttattctagattagttaagtaccactgccaagatgtgtactttctgcggctgttcaagtattaaactaggtttctccaagctacctagtggaattgaatgtgtcccagtcctgtgtaagctctggagatctcttggccagcagcctctcggcaattgttctttccccagtggttgttctttgcccaatcccaaggatgccatcctgctcagccccagactcaagagaacccctctgcacatttctggagtcattttctgagtagtttattcatctctattctctgccttaaaagtcccagctccctcagcctccggaactccaatctctgcctcaacaggaccactgggttctgttggggttcactcttcctgcaccctggttcagaaatcccccgcaagcagggagccagggaaattgtagggctttcttgcttcattttccttctcccagcaatcacagtctcagtctacccactacccagtgtctgacaattgtcattgcacatgtctttcttatccagtttttcagctgtgcgtgacagggagacaactgccgatgctcttaccactcaaggcaggagtgcttctaagttttctttctctctttctttctttctttctccttccttccttccttctccttccttccttctccttccttcctttctcttttttcttttctctttctttctttctttctttctttctttctttctttctttctttctttctttcttctttcgacagagtttcgctcttgttgcccaggctggagtgtgcaatggtgcaatcttggctcactgcaacctctgcctcctgggttcaagcaattcccctacctcagcctcccgagtagctgaagtttccatagttcttctcggccctctattccctgaaaggagtaactgcttgctatagtccctgccttgtaataccttagcagtcggttgagccttttcagttctccaatacaaccagagagctgtgttgctaacagggatttacactgcgctctctccatgggagtaatatgtgtttccatctcccatcaggaccgcccaccttccttcagagtaaaagcgagagatggagcggagggctggtggcatggtgacaggtgatacggatggtcacctttttctgcctaaagaaaagggggcctataactagaggggaggcccaggaagagttcccaggggagcccacacggtgttccctggagtcaagaggccccaggtcaggtgtccgacctttacaggagagccagatggccagagcatgggttgctatgtggaagggccagcaatgagagggttgtcctggagtgcctctcggggactggcagggccacggagccaggtgcttcctctggctaggccatgctagccaggcacggtggctcatgcctgcaatcccagcactttgggaggccaagtcaggaggatcagttgaggccaggagtttgagaccagcctggaccatatagcaagactccgtctctacaaaatataaaaataaattagctgggcctaacggtgcccacctctggtcccagctactcaggaggctgaggcagaaggatcacttgaaccaaggagatcaaggctgcagtgaacaattatctcaccactgcactctagcctgggtgacagagtgagaccatgtctcaaaaataaaataaaataaaataaaatgaaaaataaaggccatgttcacaagcgcaccctccaggaccagatagccccagcagacaggtgcaagctgggcctccaggagcaggaactgagggaactgtgtcacatggaagatgggaggtccccaaggggaagggagagggtgtccaataattcctaaaagtccccagagagaaagcctcaccttgggcaccaaccggcccagttagaaggtacctactcagttcctatcgccagccagggatgactgcttcacccctttatggctccccacctccctctcacccacctcccaacaagcaggagagccagcaggggccgttgaactaagtctgatctgaagctgcctctttgactattttaagtttggcctaaagttctttccatgcatagtgagctgtaagctacctggagactgaacagactgcagcctactcttgtgccaatcaccgagtttctggcaatcgaaagcggccaactgttcaaactctgttcacataaggcaagtgcccagctgcaatcaccctgctgcttctgcacctcacttctgtgttctgttcctcactttcccttttttgtccataaaccttcttccaccatgtggctatgttggagcttctcggagcctattctgctcccggctctgcccaatgtacaaatcattctttgttcaattaagcctgttaaatttaatgtttttttaaaaaaatttaatgttgtttaaggtttttcttttatcacagaggaggaagacacacagagagggaaaagatacaccccttcctctactgcaggtttaggaggctgtggggcagggagagtggaaagtttaacttcaataagaacgttaaggccgggcgcggtggctcacacctggaatcccagcactttgggaggctgaggcacgtagatcactttaggccaggagttcaagaccagccatgaccaacatggtgaaactctgtctctactaaaaatacaaaaataaaccaggcatggtggtgcatgcctgtggtcccagctgctcaggaggctgaggcaggagaatcacttgaacccaggaggagaaggttgcagtgagccgagatggtgcctctgtactccagcctgggcaacagagtgagactctgtctcaaacaaaaactagaataaaataagataaaaacctttaaaaactcctttagattagtctggactatttggtacaggaagatgagacagtgtcttagtacctgcaaaggaccagaaagcaatggaatctaaatgacgcccccaggacagggatccaatggagcaggcgggaaaggcagtcaggtggaaaatagaaaatgatttcattatttcagccccagcctagctccttcagtaaaccagttacaaatattagatgcatgaaaatcttcataggaaaagagatgggagcccagagtcccagacaaagagcaggcagctgctctatcttccctcggtgccctgccaccccacggcttcccctgcaggccacgctgagtcccccaaccctgcggcttcccctgcaggccaccctgggtacccccctaccccaccccatggcttctcctgcaggctgttctgtctttcctgagtcccccaccccacggcctcgcctgtaggctggtggcagtcctcagctccagaccttccccacgacccaaggttactctcagggtggagccagaaacaccggccctagctcccacacacacctgaagacctgtgtccctgcctaaccatgtgggaccccagcacaggtatgtagatgtgacaggccacctgcactccagctggagagaggaaatagatcaggcatcagtcagcagccctcagcaaaccatatgaggctagagcacgcgtcaccctaggaaaacggagcctcttccgggaagaatatcttctcaaaccagccatggtttgagaaaggctgtcaggaaagaccagttgttgttttttctgtccaatctgtcacagatctatattttgtaaaatgcagtacaaatgagttattaggaaaaattgaataaaaacaaagcactcaaaatacaagctgaaaatttgtattattagattggacggacataaaattactccatcaaattacaatttctgtacttatttcttcatgggccagccacagccagtccacggaccatgctgtgagcagccccagcccggccaggaactgttcatggcagccagccctggccactgcactgcccaggaagctggtcattaaaacttgcaggccatttggcagacctaggccatacctttcgtgtctccctgctggcctctccagcctccttaaagccacttctgattaggtcagttcccctggcatcagccttcagcagatcccccagcgtggatccacgtcctccttctctgactgctgtgccctcttcctgacctcgcgtatccagtcctgaccgctctcaggctccacttcactgccccaccttgtgagtcctcccaataccatcactctgaggattttcaggggagttcgtccacacttctcttatttctcatttcacttcctactcagcactggggttcttataccgacctcttaccttccctgcgagatcgtaaaatccttgggggcaggattcatttctgacttatctttgcatccttcataagagctggtacagtggctacccccaaaccactgacttttattaatgattgaaaacattaaggccagtcgcagtggctcacgcctgtaatctcaatactttgggaggccaaggcgggaggatcacttgaggtcaggcatttgagaccagcctggccaacacagtgaaaccccatctctaccaaaaaatacaacaattagccggatgtggtggtgtgtgcctgtacttccagctactcgggaggctgaggcaggagaatcacttgaacccaggaggcagaggctgcagtgagctgagatcacaccactgcactccagcctgggtgacagagtgagaccctgtctcaaattaaaaaaaaaaaaaatagaactctctccctgagtctggatggagtcatttgggcagagataagcagctgtttgtctgttcttcctaccttgagtgccagtaagtcccaggccctgaaggcccccagtctgggaagttccctcagcactggggaaaaaggtcggtcgctaagtggacagtttgatgcgctctgtgcctctctgagcccttcagaaaacgaggacaccagctgtcccctgtctcaattgagcaggacgtctcctttcatttctcctgggcctcttactccctagcagggtgtcagagcccgctgccagttgtcccaagatggggaagcggccccgacagatggaagatagctcagtgctgtgtgaagggaaacggcttttgtttcagcccccggtgtgtgtggcaggcacgaggcttgatgacagggtgatgagctgtggaaggaatgcaccacagggctggaacacaatcgtgctttgtttttgttcttgcatctgagaatgcccctggactgatggcagcgacgaggcccaatgtgccacatttcatcctacaggcgccaatccacatccccccaccgcagagaggtggctcttcctgcaatccggccgcgatgcgcctgctgtaaatcagcgtggctccccccaagtcaaaggccgtctgaacaaggtgacagagaaatgcaaggaggatggacagcctcgtctggctctgccttggagggggaggctgcctggcctcccacagccgggacaggttccctatgtgcagcgctgcctgcgagagggtccccaggatgaactcctgctgtgtcactcctcagaacccgagtcctgtgccaaggacggtaactttagctatgaaggggagtcaagaaagagagaaaaatgaggagaaagcaagaaaaacagaaagattgaggacagggggatagaaggaggcagaaggggagaaatgaaggaagaggattttaaaaaataaaaaaaaaaagaatggacgcagcaaaccaccatcgcacacgtatacctatgtaacaaacctgcacgttctgcacatgtatcccagaacttaaagtaaaattaaaaaaacaaaaacaaaaaagagagtgtgtgcagggtacctcccctttacaaaaccgtcagaaaaaagaaagggaatggacaagaaagaaaagacgggaaaaaaagggaaaaagtaaggacatttttaaaggggggagaagagatggcaaataagaaatgatgttggcagtaatggcttttgagagccttactgattgatagaaaatatttcttagataggtttcccctccaggagaggactcttggttcaagctccctcctctcatgctggccaggagcagggctgcagaggaagctctgagtttctcagagaagcctagcactcccttctcttccttctaggcagccaaagtcctgggaggcacaagaaagtgagttacaagttccactctgtcccacagggaggctgcaaagtggtgtcatctctcagaggaagtcggctgagctggctggaaagtgtgtaagtgtgtgtgtatgtgtgtgtgtgtgtatgcgcgcgcgcttgcagcttctctgccagagttgggaaatcagaggtctgatcacttttgactctggtgtagctgttttcctcttgtaatcctcagtgtggtgagcagaaggcagtggaaaacacactccgtgaagtttttttccattagaaggtcactaaactgtgtaactcagaaataaggttctgctgcacacatagctttcaacttacatattcctggactttggacaacatcttttgtcccagaaatgagagaaggaacaacacttttaaattatttttaatttttaattgtggtaaaatacacataacataaaatttaccatcttaaccacttcaagtgtacggttctgtggcattaagtacattcatgttattgtgcaaccattaccaccgtccctccacagaattcttgcaaaactgacactctctacccattaaacaataactcctcatttctccttaccccagcccctggcaaccttcaacctattttctatctctttgactttgactactgaagatacctcacataagtggaattatgtagtatttgtctttttgagactggcttatttcacttaacatcatgtcctcaaggtgcatccacattgtagcatgtcagaatttccttcattcttagaaaaagcaaatgctattgtgtagtacgtatacagcacatttcgtttttccactcgcctaccttttggctattatgattaatcctgctatgaacatagatgtacaaatatctctttgagtccctgatttcagttattttaggtatacactcagaagtggaattgctagatcttatggtaaatctattttgaagcttttgagaaactgctataccgttttccacagtagctgcagcattttacattcccaccaacattgcacaagggttccaatcactttctccacatccttgccaacacctgttattttctgttgtttatttaagagattgggtctcgctatgttgcccagactggcctcgaatttctgggctcaagtgatcctcctccctcaccctccttaatagctgggattataggcacatgacaccacatccagataatttctgtttttgatagtagccattcgaatgggcaggaagtaatatcccattgtggttttgatttgcatttctctactgattagtaatgttgaacatcttttacttgtttatctgccatttgtataccttctttagaaaactgtctattcaggtcctttgtgaattttttaattaggccatttggtttttgttgttgttgtagaattgtaggagttctttaaatagtctggttattaatcccttatgaaatgtatgattttcaaatattttctcccatgctgtgggttgccttttcactctgttgattgtgtcctttgatgcaaagaagcagaattttaagtcaactgcaatactatggcacttctcgagatgtcactaaatgtgagagagaggccaggtgtggtagctaatgcctgtaatcccagcattttgggaggccaaggcaggtggatcacaaggtcaagagatcaagatcatcctggccaacatggtgaaaccccgtctctactaaaaatacaaaaattagctggatgtggtggtgtgtgcctgtagtcccagctactggggaggctgaggcaggagaatcacttgaacccaggagactgaggttgcagtgagctgagatcgtgccactgcactccagcctgacgacagagcgagactcagtctcaaacaaacaaacaaaaaaagtgagaaagaacaagataaaaccctaccctgatgactgcaaagtgtgtgcacccccatccaccagtatttcagcctagcctcaccagaacttgttgaccaagttaggacataacccacctcttccattaccttccctatcagagtctgtatgtgaggttcccagaaatcctttctttgcagacctatgctaaatagaaggttttgtgtttgggcttttttgttgtttcattgtctggttgggttttgttttgatgttggtggtgttttggtttgtatctctgccttctgactatggtttttcaagtcctgcagcaaggaatcttgcagaattaacttcacataaaggattcaaatgaaccacttattcggaagaaaacatcccaggtttgctggccagttcagctctccacactttgcaccaggagggatcattctaaaaagtgatcccaaggggagtgagccagatgcagacatttaactgttctgcaagataaggacttgaaagcatcttataagtgagcactcagcattcaaggtcctggctctaagttttatgagccctaattctgatccagtgtcagctgctggattctctgccaaagaaatactggaaaaccagcttttcttcaatttcattggtatgtcagccactgatggacatcgtctgtgaagccagaccaacctttaaaacatccaaatatattggaatgagtgcatcattttcttttcgcaatggaaaagcaaagctagtttaatggacgacgacgtcaacccaatagtgccaatagtgggtgggggagagtttcgcaggcagggacaggaaaggtcctggagtgctgcccaactctccccactttagagtcacttgcctttccccagggagccccaccaggccatgctctgccacactctgaagtccaattggttcaattcattcctcttctttcttaaccaccccttacaagtttcttgaatttaaggcatgtgcaaggcactgtactgagggcaatggcagtggggagggagacacagagctcatattatacacggcagctgtcctcatggtgctgacagacaagtggaagtgatgaaggaacaatcaagaaaaagagtgatcaatacaggccgggcggggtggttcacacctgtaatcccagcactttgggaggccgaggtaggcagatcacctgaggtcaggagttcgagaccagcctggccaacatggtgaaaccccatctctactaaaaatacaaaaaaattagacaggtgtggtggctggcacctgcagtaccagctactactctcaggaggctgaggcaggagaatcacttgaacctgggaggcagaggttgcatgagccgagatcacgcgactgcactccagcctgggcaacagagtgagactccatcccccaaaaaaaaaaaaaaaaaggtaatcaatacaaagcagacttggtaccacaatttaacattccactcgaccccaagtatgtaggggcttccagcagaggggccagtgaggaggggaagtcccagtgacctggcattggaggtacattgtacacacagacaccaacacaaacacaagcacacatctcaatgccagcacccacacacgctgacactgatatgcacccacacacattcacagatacccatacatatacacacacaccctaaaaaagggatgtgctcttcccacatcagtgccgggatacatttttttttaaacattcctctcctaaaagaaatgataaataggttgggcatggtggctcataactgaaattccagtgctttgggaggccaaggcaggaagattgcttgagttggagaccagcctgggcaacctagcaagatgccatctctacaaaaaatacaaaaattagccaggcatgctgatgcactcctgtagccccagctgctcaggaggctgagctgggaggactgcttgagcccaggagtttgagcctgcagtgagctatgatcacgacactgcactccagcctggggcaacagagcaagaccctgtctctaaaataagtaaataaataaataagaaatgataaatggacaaaaacccagggcttcctaaagcagtttggaggcccaagaagacagcccggctgaatttataacatatcaccatcctttgccccattctagataggtttcatatgcaccttataaaaagtacaccccaacttcctggaaggggtggggtttttaaaggagtagattaatgttcatgggtggtagttgctagagttccaggtgaagaagagaagcaccaagctctgagtgttttttgcagaattccaagtcctctctgcagatgtacatttattcctgtaagtggatgctgggctttcgttttatgtaccctggctcaatttcagcgcaggtcaagttcaaatgcttcatgcggcatggacagtgatgagccttgaggaagtccaggtggttctgattaggtctggaagcacataactcatccaatagagaacccaatcaattgcaaaggtctgggtccctgttcctgcctgctgggtccaagtttcattcctgttggaatgtaacttcccgatcaaagacaaaatctttgattccttcttcccacctaccctcccaacaaaaagtcaccgaaaaaaaaaaaggctggcttggaattgaggctccagaggtttatttggacaccacccaccctttgtaaatcaacattttaacgagttaagtgcacatgaatcagaaacacagggtcacatttcctctgaaatacttgggggtggggatgcaaaatgcactccgaatttggcccagtccagaatcaggaggcaggccaggcccttgtcaagattctctcatcccagtgttcggcccagcagccgggaccatttcccccagccgtcctcagctgcgtcaggactgagcggaatggtgctcacatgccctgccggccgccactaggataatccatgccaaccccacagaatgggaggcgagcgatactgagaacaatgaaggggtctgacatggaaatttcagtaggaaacaagcaattacatgagaacaaacattcccagtgccacttacaacaattggaacacaacagtgattataaaaatgaaagcaacaaattgagagccagggcagcatgcaccttaaaacaaattgtcctcctggtgcagagctgcgaccctctccctgggcaactgtgtgactgtgtgtgtgtgtgtgtgtgtgtgtctgtgtgtctgtgtgtgtgtaacacatgaattttatttgacttgtcttagaggctggatctcttatccctgcggtagaaaccacttctcctgagcaaactggtttccatccaccaggcagggaggaaacagtgagaaaactggagaggattttctctggccctgctataggttcagtctcaggactgtgggaaaatgtgcacggcaggggaaaaggcctgtcttctccaactcagggcagaggcaggtttctaatgaagagggcctaggaaagaaatattttgcagggagccaaacgtaccaggacataccagctttccttgttttcttcatcaagatccacagaacagtgaagctcattctagggttcgaaaggtaaattatttccttccatcggttgagtgaaaatcagtcctctgggtctcatgcacatctactcagtctccattatgggatgccttccttatccagctccagcctgtgtttctcattcatagctgtcaattctggcactgcagggaggaggcatctgaaaataaggcggcagcctggggaagtctggagaggatgcagggagtttctgcgtggcagtggttggcaagtggggagcagagctagcaaggcttcacgctgatatacattgcaatttacaggctggtacttatttttttctctaggcaattactggctgcctcctgctcctcctcttctgtaggggccttggggcctccctcaagcctggcccagctcggggcctgatttgtgcggctaagagtcattgagcaacctgccaagactagcagccaagtttggattcctatggccacagctgctggccttgggagggagcactgaccccagaggaatccagctaaatctgtggaacccaccctggttgtccttgggccacattgtgaaatatgcacttagattgtgggttgggttgtggcatgtgatctctttattccttcagatgatgggcctactcatctagttgatggggcaagattacccagatctgcataagccccccagagaactatgcagcaaaaatggaaactgaggcccctaaaccacccttccaccctcaatccattcccaagtacaaacaataacagcagatgctagtgtaaatcattaaaaagtgcaatagatggctgagcacggtggctcatgcctgtaatcccagcagtttgggaggtggaggcaggaggattgcttgaacccaggagttcaagaccggcctgagcaacatagtgagacttgtctctacaaaaaaatttaaaaattagcatggcttggtggcttatgcctgtagtaccagttaatcagaaggctgaggtggaaggattgtctgagcctggaaggttaaggctgcagtaagccaagatcacaccactgaactccagcatgggcagcagagcaaaaccctgtctcaaaataaataaataaaactaaaataaaataaaaagtgcagtagagatggggatcttgtgcaaagcattttagcagaatctcctgttttctttctaattcccttccttggaaggaaatttattgtgcagttctgggttttttttttttccatttcaatagatttagggggtacagattgtttttggttacatggatgaattatatagtgaagtctgggcttttagtgtaaccatcacccaaacagtgtacactgtacccaataggtaatttctcattcctcaccccactcccaccctctgatcttctgagtctccagtgtccattataccactctggtggacctgtgtacccacagcatagcttccacttataagtgagaatatgccagtatttggttttccagtcctgagttacttcacttaggatagtggcctctagctccacgcaagttgctgcaaaatacattatttcattttttatggctgagtagtattccatggtgtatgtataccacatttcctatattcactcattggatgatgggtacttaggttgattccacatctttgcaactgtgaattgtgctgtaataaacatacaggtgtaggtgttttttgatataatgacttttttcctttaggtagatacccagcagtacgactgatagatcgaatggtagctctattcttagttatttgagaaatctccatattgttttccgtagaggttatactaactttcattcccatcaacagtgtataagcattcccttttcactgcatccatgccaacaaactgtgggttctgattgctttatttatatttaagccctgacacccggggatctcagagaagctggatccctggatcctacctggccagccaatgggcaggcttcctgagggtacacagctttaggactgtggactcaggcactccagggaagcgggaaataagaacttctccttagtgcttgcaactgccacatcagaacttagctgaaatccgagggatcggatcccaaatccttcctcaccagcccccatccaccagtccttttgctcaggtgataggaaggtcatcctaatgataaccacgtggtgggtttcagctgtggaaaattcctggcccctttctccttcttcccaccccctccttctccccttaagcacacacacatgcagctttcccttcctttatttaagcaaacaactctccatgattgggtacagccccttcttatctaaatagtctgcagatgcatgaagatgcaggcgctttctgctcctattcggagcttgttctggtgcccatcttctccaaacctacaacaagtggcctcccttagaccttgctgacagcaatccctactgcctgctcccctagtaagtcagctcaggggacaggctgtcctcaatgtatcaggggtgggattttccctccaaagacttcaatttcccctctctttcttggctcctcccataacctgaggttgaaactgcccagacatgagcaaatggaacagggaaagtcccaattttgttgtcagattcctatgtaactttagttgtccaggtacataccaccagttggttaacaccatcaacccctggtgggtctggggatgggggctgaggactgggaagtttggtaaagggcacagtccataatgttaatagatgggaaaaataggaaggaacctgtgagtttccataatgagcagggtctgagggaaaagaattaaccctaaggtctaggacaagaatgaaatctaatgagtgggttgagaagatcagccccagctttgggtttataagcatgactctctggtttgattttcttcccattccaaagcgtggtcaatattttgagtccttaggagatgggctgtgctgatcatagagatggtgatactgtaacagggggtgaggacgcacctgaaaccatcagcctgttagagcttccctacccaaagtacattctgcacactgacagcttcacagcttcagcctcacccgggtacccaaggaaacgtggtacacatacactatggaatactacgcagccataaaaaataacaaaatcctgtgctttgcagtcacatccaaatgccacatgttcttactaataagtgggagctaaacaatgggtccacatggacatcaagatagacagaatcaattctggggactccaaaaggaggaaggggtgggggcaagaattgggaaatttcctattgggtactatgttcactatctgagtaatagagtcaatagaagcccaaacctcagcatcatacaatatacccttgtaacaaagctgcacatgtgcccccaaatccaaaatttatatttaaatttttaaaagattattcaaatgttaatatggcccactagtagtttgcaaaaaaaattatataatctttggattaagaaaaataacctcttttgatattaaaagcattacgagtcatgtgtgctttaggtacttatggattatttgacaaagctccattggataggccatgtatgtctttatacaaataaaactggaaaaatatgaggaaaaaaaagaaaagaaatgcagaattcaagcccacctcagacctacccttcagaatcggcattttaacactggtcctcaagtgagtcatatacatattaaaatgtgagaaacactccttggacagccaaatgtactcagtcttaaggaaagagggctcgttcccccttgcatttaacttgcctctattagctgatgccgggtaagatgaactcacagagcttcagaagggactgcggcaatatgaagtgtggatgtggggagagggagatgacaaaataacttcctgcctctcatccccgggccacgcaggtcctatgagaatgttttgcaaagtaagatcccgtgaactgctggcatcagagaaacctagcaccttggttctagagcccctttgccaaccttcccaaactttcccaatcagaatgtctgggggtgggagccaagacccacatattagtaagctccccttggtgatactcacataggctgaaatttaagaacgattctccctctgcccttcaattgctattggatgattagtaccatgtcccaccctcaggagcaaaagtgaattgctagcacttctggacccaaggaggggagacagcctttgaagttaagaccagcctacctctgtgtcccttggtcttttatacctcctgcctagggaagtgccgaaatttttcattaaggaggtgcaggtgccatgcagcttgaggacaagcctgtggttccaagtgctgccagcatctctgaggcacaagcgtcaagcagtcctgacccttgggcaccccaaactccaccacggtgactccagcagctggaactgagatacctttgcacacacttcatcatccttttgcagacttaaaaaaaatggaaatggtgggtcatggtggtgagcttcagtagggggtggcaatgacatctccacccagcctaaataaattttctttcttattaaccacagggagctaaaaggaaatatggacattttccttggctggactagtatctcactattttaccagtcaggtacattagcatgtgagaatctttctggactacagcatgactttgatagaatgtttacaagtcctcataccacaccttaaaaaaaaagttgtgtctctgtgcttgggcgtggatttgggtaacctgggaatattttatcacttctgggtaaaactgacagttgtctgcggtttggaggtgacttactgatcagggaactacatccactgaagttgtcactgtaattgcttgcagaattagaagtcacatggaagaattcctgaggcaagaagcacataacctaatatgaaacagcttgggctgggtatggtgcagcactctgagtccaaagggaagctcggcagggagcgcagacatcacgcctacgcaagtgggatgcaggagccctgggttctaattccaaccaggcgagtgacctgggagtcccagactagttgggaaatcccagctatatccccatcttacgttaaaagagtggatatgttcctctccaaggcctcctatgtgtctaagactccagataaggacaagttttccaattctagttggtaattctaacattgagttgagccggaggggaaagagaatgtttccatgagaaacatggaaaagaaattcaggcagggccgaaagctacattcttgtagagcaagcatttaaccttctctctgatctgaaacacacacaaccaggagaaacacttctggaagttatttataggagcagatggtaaatgggagggtgggggccacgggtagcctgtggtgcctcccaagttctccttcagcccacccacacccagttaccatttgcaagctgttgaactgggaccagaaagcatcactgaagaaactcaagaggagaaagatacatgtggttcaccggaaagggtgagaagtgtatgactgagtgggaaaaaaaagtcacagctcacagtatcattgattaattgagtgattttagtcaagtgaatattgatacatggctgaaaaagcatgaaaataaaatgaacacgtacgggaattactattaacataagcgataacatcaaaacatctggtaaaatgcagttaaaaaaacaacacaaatgaaatggaatgtaaaacattttcacagtattcaaagcttttgtaagagacttaggatctaaaagaggagtactacaggaagaaactagaggaaacgggaatttcatccatgtcctgtgtatctgctggcaacaggtcagaacggccagtatgttattccctgcaggctgcctagggtgctctcctcaaacagatcacctgagcctcctgcatctatgaagttatgacacagcaaccagttactcagagtctgatgagaaaaacagattttaggtttgggaaatgggattactgtaatttacacatccaaatgcaaactggagctctgattgaattctaccctggggagaacttgatgctaacccacaggtaccaagagccaagtgttacacaggatattttaaaaataaaatgtttttggaatcctcacctcccatgctatcttctaagataactacaaatattcttcaaagatttaactgagttctgccaaggacctcccaggactctatccagaatgattattgtaaagctttacaaatcccaccttggccctagcgataattaggaaatcacaggcaaacctcctctctcggagaccaatgaccaggccaatcagtctgcacattggttttgttagatactttgtggagaaaaacaaaggctcgtgatagtgcagctctgtgcctacagagagcctcccttttggttctgaaattgctgatgtgacagagacaaagctgctatgggtctaaaaccttcaataaagtaactaatgacactcaaggtcctgggactctgagacagacggtggtaaaacccacagctgcgattcacatttccaatttattttgagctctttctgaagctgttgcttcctacctgagaattcccatttagagagctgcacagcacagtcacctgctcttccgtattctgtggtaactactaatgttccaggtaaacccctccactaaggactctgccgcagagagagggcccggttgcatgaggcactttgtcaaaatgagcagatacgtatgagcactgaactcttgagtgaatcaaccagaactaagacccagatccacgcactcaggaacttgctctgaatttcagtttgacaacagagaagtagaatatttctaattagctaatatatatacacattttttaatcatccaaaattacaggcaaatcacttaaggtccccagcactttacgatgaaaggtcagagagaaccccacaaaaaaggtgttaaaaggacaggatcactaactgtgagaggttaatttatcaggataactctccggtaggtaactaggcgggcatgctgattttcatactggagtcttcaagagttaacagaatctaccatcctttcctccgggtcaggctagggccgcagggggccactttacagcctcactgcagcatcctcactgggtataagcattggcccagagggacaatcataaatgtcctcaaagtgttgcagagaattaagaatccggctttgggggaagaaattaatatgcattttttttagaactacttcctgtacattggacaagaagggtaaagttgtctaagtgaactggcttatatacatcgctgattaaacataagggctttgggaagtatctcagggtacttgggaaaaactgcagagatgttttgcttttgaaactctctcgctggatggggacaccccacccatgtcaactttccatctgcagaaatgaaacaaatatatgtaaaaagtgcggggggacaggcaggctgttctgaatttctttgatccataggcaatcaagttcaaaggaaatgtttctttacaggaaagaaaaaaacggaaagctctgtgagttttgctagggggtgttaggttctagggcaaccacggactcttcaggaaggaaagccacacagctacactaccagggaaatccgcctcccttggcaaatgcctggggagagctgctcctctgggaagcagcctcggacggatcaggagaccttgttctagcacacctttcaaatgctcaatgtagactgttttaaaaccttgaaaaataagtgggtgtttgtcattgttcttttaaaaatgtgaaaaggaaaaaacatgagattagaatcctaagctcttcacccaatttcacaattcaccctgactagcaatttgctggactgttctaaaatttttttcatttgtttcttttttaactatgtgttttgaaaactactgccttctcagcccgaaaatcgccgtctctctcaggctcactgtggtttcctttttctgacacaaaggcaggcacaggctgcccctccacatgtcttggggatcagatcatgccccgggctcataggaaccgaaactttggggcatctgagactggctgattcagattcaaagacaatcacacggaaagactgtgggcagagaaggcaatgcctctcccctggtccctttgctgtcactattacataatggacttgcacttttcctccctgcacttatcactttctgggcttgaccttaattgtaagtgtggtatgagtctgtttccatttaaagcagacagaaagaaactactctggacctgaaaacaacgtgacttgccaatcattagaattttctagttgaaaggcatagatcagccaatagatccacaccaacaagttgcaaaatgtagtttttgctgctggctctcactttccgcccaatccccctttttgtgttttagtggctgtgttgctgttggaaatggtttgtcacctcctcctgtgcagtggctgctgctccacattgcggatcttaaaaaccttcctaatctaaatggcccttgctttacccggccatggctaccctggggtttggagcgtggctatggagggaagggagcgggaatgctgcaagaacaagccgactggattacaatgtccactactgacaggcgcagtgcgtgtgtgtgacccaccgggttcccggggcactgtcccccccgctcccaccccacccgaggctccctccccaccctgcccccgggagaatcacttaaacacggactgaaaggtggggcactcatggtttttcattttcttcatgaagtttttgaactccttgtttttcttgtcccacttgtggatggccgtcagcaagtactggctcttcaccttgcggcccatgatgaggaagtggtggctgaggttgtccagctggtggcagggacagtcagccccattcttcaggtacagcacaagcttcttcaggtccttcttcttgatgggccccaacttcaggggcttcttcttcttggggacaatcttcttgtcgccattttcttttttcacttcttttattttcatcctcagtgctagagatggagaggacagaagaagagaaaagagggtaagagaaagcatttagaacacagcttttctttttttgatcctcaaagtgattgcattttattattttattttttggcttatactttcttcttgtaaatatatatgtttttaattttagattcaggggcacaggtgcagagttggtttcatgggtatactgcatgatgctgaggtttgggcttctaataaccccatcgcccaagcagcaattacagtgtcggccatcctccctcatgtcttttggaatctccagtgtttactgtggaacaaagcttttcatctagaacaataacccaagtgtacagctgaggtggagaagaaaatgaaaggcaagtaacaagtcaagaaacaggcagttttatccataaaaaccaaggtctgttaatcccagcactttgggaggccaaagtgggtagatcctctgaggtcaggagttcgagaccagcctggccagcatggtgaaaccccatctctactaaaaatacaaaaattagccacacatggtggcaggcgcccataatcccagctactaaggaggctgaggcaggagaattgcttgaacctgggaggcggaggttgcagtgagccaagatcacaccactgcactccagcctgagcgacagagcaagactccatctcaaaaaaaaaaaatcaaggtctcagttacccattctgccaccgcctccgccccctattctgtggtgtccagtggtatctctctgtaatggccatcggtgccaggagatcctcaaataaatttcaaagctaaatcacattgctctttttaaaaatccagttatcatgcactgctttaagagaaaaaagggtcctataacccaatttactccacatgatctgatgctattgatctcatcattcaaagacaaaaaatcctgagtgtttttgttttttattgttgtctttgtggaggcagggtctcactctattgcccaggctggagtgcagtgtctcgatctcggctcactgcagcctcaaactcccgggctcaagcaattctcccacctcagcctcccaagtacctgggattgcaggcatgcaccatcatgcctggctgatttttttttttttttaagagacggatcttactatgttgcccagaactcctggactcaagaaatcctccctcctcagcctcccaaagtgttgggattacaggcatgagtcaccacgcctgaccatgagggtttctttttgtttggttttgttttgaagagcaagttattggtttagtattttaacattgaaagacctacaattccttgaaaattgagtcctataaaatgacaggcagaactatgtgtgtgcactcagcaagggaaagttaaaggttgtttcaaatggtcatgcttcctgcattaaacatcaacgtccaaccacagcatgggagaaatcagtttctactactgggtctctatggcggtaagacagcaggtactgctagtatcagtcaatcgctaatcaaccactaatccccactgacaggcagcactaatgttctgccaactgagaagacctacacaaaatccaaatctactttgactttctggcagattagagcaagttctggtgaagtcctaattgataaatccaggtgatgagctctcttcaaatccaatatggtaccagggctgcttctgttctcaactcccaggagtgtgggaaaatcagcccattcaccaactctgctttctcttttctctgtcccaatggacactgaattaacagtgttaacctgtgagccacatcctgtagcaatgactccacaggggctgctgatgaagataaatgagcgtggacatgctctataaacgaagcagactgaacacacagtgtcgcgggtacaatcaactcccctttaagactggtcagcccgagatattcccaaaggagttggaaatcactttctaggtgccagtcaccagataatttgcgtatcttctgaactctttttaatagaaaattaccaagccccctctttttaatgatgcaaggcttccacccacacaccctgaggaaagtctttaacctgaactaaatcacagtggctaacaattatgaaagcatgtgacctgccagaacatgtgctaagtattttccgtgcatttcctcagttaattctaacaactccaggaggaaggcataattattttcccatctaatagatgagaaaactgaggcatagggggttaagttggcttgcctaaagtcactaatcctaagttgaaacccatgtctaaatgtgcacttttaatctgcatgttgtccatgctgactctatggttccaaaattctttagaatggaccccaaacttggagtactgattaaatggaccaagaagatcacagggaggagctcagaccctcttcccagtttcacctacatttcaaaatgacttcacttatgaaatggcaaaagagtgcctcctggttgaaagagacttctctggcaaaggagaaactgcatttgtgaaagctttattatttaatattttaatttattttatttattagagatgggagaaactaatgcatactccagctgacaaggcgagcgccctcttgtctgcagagaagtgagccattgtaaggtagtacccaccacatgctgggctctgcagatgagaatgggatatgtctatctacgactccttgtttaatactcgcagcaaccatgttaagaaggcatcaatagtactttattataatcaaggagaaggactcaggttaagtaacaacagcatgaggccacagtttgtaagagacagaatcaggatcagaacccacacctaaccccaaaaccactctttcctgccatacacaccacgacccggttagaagtgatattgcttcattggaaactatttcactcttctgattgtgttgctttcaatcacaattcaaatcaaaaattaatgttcctttgccatgaccgtgtaaaggaatgtagtttacgtaggtgggggagcagccagggaggagaaatcagagtatgggaatgtgttacacattagactttacttcttgtcttgccacttggcccctttctttttttgaggtggggagagcaggaaagaaggcacgtatggccagaaattactaacatctttccatctttcaagggtttgttttaggagtgcagactaccaacaatgttgaaaagatcatgagctgtcccgggtggatttttccttgtgggtgtgtgtgcagaccccaccatgatgcatcccggggctgctggggcgagggcaggtgctggcccaagagcagcccggaactgatcaccaccaccccatcccatcatgctcacagggcctgggccccagcgatgttgcccatggcctgaatttgcaatgcaaatggtggtggtgaacaaacagaagcccagaaggtagcagctggggcaacagctggatacagtcccaggtcctgggttcttctctgagtctcagtactctgtctgtaaagtgcagggcaccatccgactgcaggcctggtggatcgaccatctgaggagcccctgctgggtacttctgggagacagcaaagtttatctccagcactatccccaccctgtgctcactccatgcttccctgattgggcaccctgctgtgcctggagcatagggctaaaactaaactaccaccttggaccctggatctcagctccctgtaacagctagaccctaatctaaaaccaaacaaaaaaattttaaaaattatgtgttttttttcttaagcaacaattttaacatcctccaagggtaggacatgactcccacctaggcatagctgccagcaagaattcagagacccagaaactttgaaaactcaaaatttgaggctgcaacaagggcctgcctgggtctttctcgggaaatcttaaaataatccattatatttgagtaggccattaagctttcattctacttgcagtcacccaaaccatttttgctcacaaattatacttccttggtagcctccctcaagaagcctggccttatttgggaagctgaaatgagaatgaggaagtcatcacacaccatcccaaaccctcacattcttcaaagccgtctcttcctcctgactccctgcttctatgagtggtgcctccaaccctcccaagcccgagacatcctacccatgactttgaacgtaaggcaaccattggcccagagccagtcatttcataaccagtcctgtggaatggctgtaggaatccaggaagggtctgtggggaaaggtggcatggggttgcattaggaatcaatcttataactcctctgatggcagatgatagtagcaatgaagggtaaagtacagagggaaagagggacatactagagagcgccttcgtcaggtgaaaggaagaagagttactgtaaatgccacgggaggccccgctgggaaaccaggcagcccagtgtcaatgaagaccacagggtccatttaaatggaggaaacacccctcaaccctaagtgccgaagagcttaagaatgagtctgaaactagagcacttcactgggtgattagggggccacgccaacccataggaggccaggatctggagtggtgagggcaaattccagagagcaaaaatccaatgggaagggaaaagaagagagaagccatatcaccaagcttctggactgagtgcgaaggagcacttgcaggcacgctagccacatggattagactgagcccgtgcaatcattcccactcttcttgaagtcagtttaaaattagagtcaaaaaaacaagttataaacacatgcaagaaagtggtaaaggaaaaaagaacatatcaacattttgtatgacagaaagcaaatggatggtagaatctggcttaaaagggagaagaaaagctaaaatgcagatagggatgccagtaaagtgcagagaaaagaagaaaaagagggacagacagggatgccagtaaaaaacaagcccatttgcactccaggtcccacaaatgctcctgattggggcccccggacactcctgaactccatcacagaggctgtcaatgttgggattggcagcaagtttacatatggacactcaaacctactcccctgggccatgagtccaggtggctgccctcaccaactccagcagtagccatgggcttcattccatacagaaggcctgtagttccagctacttgggaggctggaggtaggagaatcgcttgaacccgggaggtggagattgcagtgagccgagagcgcacactgcactccagcctgggtgacagagcaagactccatctcaaaaaaaaaaaaagaaaaagaaaagaaaagggggaaaaaaagaaggcctgaacctgcacacagcctgccgctggggtatactagacacagaggaggaccggacaggtgctgctgcgtgaacaccaaagggttacatgaaagtctgcaaagtgaagaatgagacactcgggtcttagaacactacatttatatgcctgtgtcagaggattgagtggtttttctctaaagaaactattaggctgttgcaaaagtagtcacggtctttgccattactttcaactgcaaaaaccgtagttacttctgcatcaacctaagaatagttcaaaagaaaagacatatgggccctctgcaaaattctcaagtgaggcctaacaaatcacaggccctgcatgtacacaaagagcttccaacgtcatgtctcgctgttaaattcaaatggacagtcaagggctggcaagtatttaaggaaagcctccaaatgtgaatggcagagactgtaacatacaaaacagaaaaggaagaaaaggaattcagagataacagagacaatgcagggagtattaaaaaaaaaaacttttcactttttgccttgttgcactcctaaaagcaagatgggtcaccagcagctctcctggagccatccaaaaaaattcggccagggttctcattcttgtcattatggcctcaatatgtgctgccagtgtttccatcagtatgcagaggaggtaggcttcattaggttagactaagtgagcttccctgaatggattatccaaggcatccaccaagtgaaagaaaccatgctagctctctgtacataaaataaaattttaaaaaaaaaactttaaaaaatgataatatggccaggagtggtggcccgcacctgtaatctcagcactttgggaggctgaggcaagcagatcacttgaacccaagagttagagaccagcctgggcaatatagtgagaccccatctctaccaaaaaaaaaaaattagccaggcatggtggtgcatgcctgtagtcccagctactcaggaagctgagatgagaagatcagctgagtctggggagattgaggctgcagtgagctatgactgcacccctgcgctccagcctgggtgacagagtgagaccctgcctcaaaaaaaattgttttaaatgataataaattagataagacttttgtattcctaaaacaagaacagaaagctattaaaaggaatgttcagagactgggaaagattacttggaaatttaaaatataagagaagaaatataaaatgcaagacaagtaaaaagatgtgaaagaaaggaaataaatatgcagtacactacatggctcagctgcaaataatatttacataattctaataaattaaacattcaatattaaccaaaagtgtgatgtaattatattggaaagatagtgtaaaagagataaatctttaacttcaataacagaaaatcaataaataatggttttaagataaggttaaagaggccaggcacggtggctcacgcctgtaatcccagcactttgggaggccaaggcaggtggatcacttggggccaagagtccaagacccgaccagcctggccaacgtggcgaaaccccgtctctactgaaaatacaaaaattagcctgtgtggtggcatgtgcctataattcctgctaattgggagggtgaggtaggagaattgcttgaactcaggaggcagaggttgcagtgagctgagattacaccactgcactccagcctaggtgacagagccagactgtctcaaaaaattttttcaagaatattttttaaattttttttaaaagataaggttgaagaaatttcatgaaaagatgaacaaaatgacaaacagatgggaaacagaggaaagaaaaagagaatcaatccaagagtttcaacatctgagaaaagggtattatagcaagagagaacaagaaaacaaacggcagaaaataccaaagaaataatacaagaaaactttccagaaatgaagaacatgagtcctcaggttaaacaacacccagctcaaagaatcatgacatttacaaatatgaaagacaaaaagaacttttaaaatcttcaagagaaaagggtagacatctaatacaaaggatcagtatcccagttgcactggatttatcaatacagacactggaaactggaggataatgaatcaatgcctttaaaattgccaaatttgatactgaggcaagctatcaatcagcatgcaagagtagaatgaaaacatcttcaggcattaacaggttttaaaacatcatctcccatgtatcttttcttaggaaactactcaatgatgtgctctacaaaaatgcagaatttttttaatttataaaatgtattatcagccaggcacagtggctcacacctgtaatcctagcactttgggaggcagaggtaggcagattgcctgggctcaggagttcgagaccagcctaggcaacatggcaaaactctgtctctactaaaaatacaaacacttagccaggcatagtgatgcgcacctgtgggccgatctactcaggagggctgaggcaggagaattgcttgaactcgggaggcagaggctgcagtgagccgagatcatgccactgcactccagcctgggcctctgtctcaaaaaaaaaaggcattattaatgttatttttgattgaaaagtaataattgtataaacttatgggttacaatgtgatgttttgtataagagaaggaatgattaaatcaagctaattagcatgtacatcatctcacttacctatttaaaaaaatgcagaattaaacaagacacgggattcaggaaaccaaaggtctaacctaagaaaggaaaaggaaggcttaggatggtttttcccgaacaactgtgtggcaggctgtgatggttaattttaggtgtcagcttggattgagggatgctgagaaggctggaaacgtgtgtgtgtccaagagggtgtttcagaggagactgacatgtgagtcagtgggctgggagaggaagagtcagacctcaatgtgggctggcaccacccaatcagctgcgagggcagtcagaataaagcaaggagaagaaggcaggtattcagcttgtggagtttctgctctccctcccttcccaataatggctgtttctcttctcctgcccttgcacatcagactccatgtttttcggctctgggactttggggcttgcaccagtggcctcctgggggctttcaggctttcagcctcagactgggggctgcattgttccaaggcttctctggttctccagcttgcagacagcctatcgtgagacttctccaatcctgtgaaccaatgcccctaattaactccctctcccatctcctgttgtttctgtttctctgaagaaccctgtctaacaaaaaagcctaaagctccatcagcccagaccaatggtaggaaagagaactcaggcagatttcctgatgcatatctgccagaaagcttggggctgaattcataatatgaacataagtaactgggttaataaaatggggcagttactatctccaggaaaaacaaaatgatgtaaaagaaaggaaataaatatgcagtacactacatggctcagctgcaaataatatttacataattataataaattaaacactgaatattaaccaaaaatgtgatatacctgtactggaaagacagtgcaagagagataaatctttaacttcaataacagaaaatcaataaagaacatctaaatattaaaaataagaaatccaattataaccatgttatttatttgctccagtttgctgaatatgaagaaatcactaaaatacttgaaaattattacttctaggtcataggaactagaggtgggaagggaactgcatgcagtttttgttaaaaaccattcattccaatttaactttttaaactatatttacgttgaatcaaaaatttaaaatttaaaaaacttagtctaataaagaatgtcagtgtatataaaatataaatgaaccacaaaatgtcagatcatgaaggaaatacagagatttcacatctccagacccttcaccctccattcagctggagcaacttggccatatagttaggacttcttaagggttttgattaagaattctgctttctcaaccagctttttgttgtttcctttttttttcttttttgaggaggaggagggaggcagtccactgatttagtcaatccccatcatttttcagataacaaaatcaattgggttagaatgcaaattatttacttagaactggaagagacgttaaatctggttcaaccgatgctcaaaagtgaagtcacttgtcagctctgcctggaacctgctccctgcttccctacccagagctttatgattcatacagcagttcctccagtaggagagcgagaggggatgaatgggggcctagccatctgggatgacggggcaagcagttggatccattttttccaaaaggtgctgttaaaaaaaaaaaaaaaaaaatcacccagagacagataccagaccacacactctgattcctaagagacttgctttttccctaaattgctttctttttcagaggggcctaaagttcccaaagagataacaagagaagtagagggcaagctagtcacagtgagactggcaaactctttttgttttttttttttagacagagttttgctcttttgcccaggctggagtgcagtggcggaatctcggctcactgcaacctctgcctcctgggttcaagcaattctcctgcctcagcctcccgagtagctgggactacaggcacacaccgccacgcccggctaattttttgtatttttagtagagacggggtttcaccacgttagctaggatggtctagatttcctgacctcgtgatccgagactggcaaactctttaagagacagggtctcactttgtcgcccaggctggagtgcagtggcgccatcacagctcactgcagccttgatcttctgggcgcaagtgatccttcagtgtcagcctcctgaggagctgtgactacaagcattcagcatcacatttggctgattttttaatttttgtgtagaaacagggtcttggcatctttcccaggttggtctcgaactcctgagctcaagtgatcctcccacctcagcctctcaaagtgctctcaaagatgtgagccaccacaccagtctgtaaactctacaaagtggcttagcccagcttggttgatcaggaaaggcccacagacgggcaccccaatgcaccagtcgcatgggcctgctccacccctcctaccccacagagcctccaggtggaaaagtctgctcagataccaaagcctcactaagccatgaagacagagcactggtttcctgcctcccagccccagatcacacatgtcttgggtaaccctgaggtctgaggcagaaagcaccctccccaagtccaattgtgcaaatgagattcagtaacagcactgggtacggcatttggctgcaagcaaccacaacctccttccaacactcagcagagttctgggcaccatggcgagctggctttgcggcactagggcccagataagtcctactgacaatggccttgcaatggcagcttaacagaccccactgttcccagcaggagccaatgtctggcatcattaattcgtttagcagagaaaggggcttgtgctttgtcacaataactcagcgtctctcccctgaccacaagccacatgctgcatacttggatgcatttgctgactacaagacatacgttacacacaagaacaaaaaaaactaaactaaaagaacaagatccaaagcagatttctttttctctcatctccaaaaacaaaacaaagcaaaacaaacaaaacaaaacaaaaaacagcagatgtggaaaatgctcctgagtggctcatttgggacaaattatttaattgaagttgtcctgttttctggaccccagacacctcaggaaggtggccaggcaggagagtagagattgcaactttgcagagccctctccccagtactcacatatgaacgcacacacgcaagctcatgtacacatgcacacacactcgccagcatcatcaatgcatacacaccagcagcatcggtgtcagccatccagaatcctgctgctaactgcttgatttcctggattgtgttaaatccccactgagttaagctaatggtgcaaaatgaaaaccccactctgagagcaaagtgctgcctggtgtgatttcatctgggaagccacgcatcttggggagcaagggcttgggcctcagagtggatcagagaagaactgtggcccctccccttcccagtgtgcagcttagcctcttccacccccagccccccaccctcaccaccatcctgcactggagggagagaaagaagaataggagaatcacttaaataaagtccatcactaggattgattgaatcttggctctgagtccaggcaaacctgccaaggcaaacagcttttcctaccatggggtcactggtttttcattcctctccaatctacttcctggtgtttgcccaaatggcaagttgaaatgtgggatggtctcctgggagggaaaagatggggagtgggctacagaaaaggcaaaaactatccctcgctctgagagatgctagagtgagcatcatcagaatcacctggaggattgttaaaaatgcagactgctgggctccacccctggagcttctgagtcagcagccatgagatggggcccaggaatctgcattggtttttatttttagagaccaggtctcactctgtcacccaggtcagagtacagtggtgcaatcacagctcactgcagccttgaactccagggctcaaaggatcttcctgagtaactgggactataagcatgagccaccacaccacctaattaaaaaaatgttctttagttttgtacagatggtgtctcactatgtttccaaggctggtctcaaacttctggcctcaagagatcctcccaccctggcctctcaaagtgccagaattacaagcatgagccactgtgcctggccagaaatgtgcatttctaacaagtccccaagtgatgttaatgctgctggcctggggatcacacttgagaaccactggtttaaagagcctgagggttgggacagggtgggttgtttgatttgtcaccttggttattcacagtggtatcttttaaggactctttcttggatgacgtctaaacatcctagaggcccagagcagccccccaaacccactggagctcaggtggaagccagcaaaattggcacaggcctgtccaagacacagcggagtagggcaaggtggtcagcactacttacagaattgctgaggtctcttccagagctgtgggtgcttgcaaaatcaagaaaacaaaagcttggatagcaagaggcagcacatttcagaggaacggaccccaagtggagagtcagcagaccccagctgaccaatcccaccactcacattttagtggattagactccaccattaacctttagcataaacttgggtaaaatcattttacttctctggatcccagcgtagccatttgcaaaacgaatgtgttcattcattgagatggatccgttcatttcagtctccctgcctgcaatggtgagctacatctgcatcttcctatttcctttccctgtctttgaaatccagtagagaagcccagaccgcacaatgggaacatcccacctctcagatggcaatgctgcccaagccgctccacccccaggggccttgcttgcatgtgcccgaggccagccctgcagggcagacagtagcacaagagcaccatcttggtcacaaagttgtctaagctcaaagacagccccggaaaaacacctgacacactccacaaataataatcagcagatcttcatgccatcccatgtgacagatggggagcagaggcctagggggctgctggcccctttgctgagagacccctgacaaagttagtccaatgcctctgcaaaatcgcagcagttgcacctcactcttctccctttatcatgttctcggtttgtcctctctgaaggaagggggtgcaggtcacctgtgcttcaggccgagctacagaccatcttctccttgatgcctccccagcccagtctagccttggccttcctggctctccttgcctcaacattgatgcagcagagctctgcatgagaatgacccacgagtgttcctacctctcctcctcccctctgtgagctcatgtaggacatggcccaaaacgcatccaatctctgttcaatgactagtgcaatgcctgacatcagggggctcagctaaacacacgtggggcacacaaatgaacagagagatggaaagagctcagccactgcccggatgttcaaagactcactcgccagactggaactctctgcacagaactccgcttcagcactaacaacaacagcaagagccagtggtcaccgagtgcttgcccaggccggggtctggtctacccacctatcagtagatgcactccgggacacctctaacagcctagaaggcagatactccaataatgacacccagtttctagatgtctgggagcagaacctttctgtcccagaaaggttcaagtcccacaactagtccatggcagagcgggactttgatccaagaagcctggctcacaacatataaacactaccagaagcaaaacgaaccacataagcagaacaggaggcctctgtcttgggggttccctttctactggggatagctgcttttcaggcctgggggcagagaagggtctcactggccccctttccctccaagagctttctaggtataaagggatttagagagggaagcatctctctgatccatcatagacagttccaaagtacaaagctaagaaagcaaaaaaaaaaaaaaacctatgtccaaaatccttcatcctcgccatcacatgattctctccaaagcaaaaatagaggcctcatctctctggacctgatagtgtcaacaagcacagttcaaggttcttgcttattcccatttctgaccctacctatttatccaactttctacacctgaatagtctctttctttttttcagctttctaggctttatgtcaatagcaggaaggcttgaagacagaggggccctggtggcctgctctgactccggcccttggcgggcacgaggtccagtctgagcctgggcccaagccacacaccttccccggcataagatgggcagcgctgggcttccctcccaagtccaggggagtgcagggggagggctgacggagctcatacagttttcctttgtggggtgcagggtcgggggatggtgcggcaaagccctgcccgaggcacacaatcatccagtgagatgacaatgtacaccaaacaggatgcagaggaacgctggcctctcaaagctgaaaagtgtcttgacctgagacaggtctggccaaagccaagaatctaaaaagctaagaggaatcagcacccggtcctatgtcaaagctggccttacctctattttctggaattcgcactccctgccctactccgctggcacgcattcaaggcagccaggtggcaccggcctcaagctgaatgccctgactccggcttccaggtcctcagaccctccctgggtctttcctttctctcaagccatctggagcctacacacaagtcacggggcagaggttctgagagctgaagggagcaagcggcaataaaaacccatacgaccccaactctgcacgccctttctacttcttcaggaagccatttcttgagaagaaacaaacaaaaagcttccctgtggctgcaggagctgctgacccatggggccaaattagcacctgcagagggacaaacagccccagccctagaggagaccacagaaggctgctggatgggcaaagactcagggcacacatagacagagctttgcaggaacgggtgctcggcccacattctggagcgcctgccccaactcccagaagcgttcctagcatgcagaaggcaagtgctttctaagtatctctaccaagtggctccacaacagacagattcttttaatgttccaagtactctccagggaccgtgcttctcttcctactgaagatagtcaacatccaggtttgggggccaaggctgagccctgtgggacaggcccgtgagctcctagcaggcatgaccacctctaatgtatgcagctccctctcctctatttccttttcctgcctctcctgccacctgccaagtgctcctacctcgttcatggccttccactccgtgcagggagggagtgggagtcctctctcctgcacctcctccccaaggcctccagtttgcatcaggggtgctgatcacagccccacctcaccagccttcaccagcaagctttgccctgttacacagctgggcacattcgggggccatgcaggcccttcaaggatttgccagtggagtgggagtgcagtgcccctcactccctcagcatggggggattgatgttgcagccacagacaggggaaaatgaaagacaaatgtcagcttgcactcacccatagctagaggcaaagtcccttcagagcacagaagggttaagcccatggctgccatccaaagagttgagacacattgaggatgcggaggcagctagtctgtcctcaggtgctatccaagcacccttgtggctcctatctcttgtgaatggatgtgtacacaggggcataatataaacaagtcacagggtcaatctgtcattgactgagggttcactgtgaagccatccctcatatactgcacacaccctggctaagcaagatcagtaacctgaggagctgcaatgctgtgtgcaggggaaacccccacaccctacagggtgatgaatttcatatacatggccaactgggaaaggcacagtctcaagatctaggatcccctcccaaccttgctgaccactctctggtgttctcgcctaccctgatcgtgatttgtccagagcacctctggcgaatgcatatgtcgtgcctcatggtcaacaaataaacaagtttcaaagggtcctcatttgtctgaagagcctgaaatgagctgctaggacaattcacgagacagctggagaccttcagagcactcagggccaagggcgcaaaaggtggcccctccattcctctcgtcaccctataggactgggttgctaagggccttttgggtagctgtttggttgcctcccacatctgcctctcactgtccctggtttgcctgcatggcaaagggcctctcacccaaggtgttcagatgtgtgcaccttgtagctctgtgttttgtaatgttagaaattaggttttggccatgcagggtgactcaggcctataatcccaacactctgggaggccaaggttgggggatggcttgagcccaggagtttgagaccagcctgggcaacatagcaagactccagctctacattttttttaactagtcgggcttggtcgtgtgggcctgtagtcccagctactcagaaggctgaggtgggagaattacttgagcccaggaggtcaaagctacagtgagctaagattgtgtcactgcactccagcctgggtgacagagaaagaccctgcctccaaaaacacacaaaaaatgcttgtttggaaatctgaaatagaaaaaaataaataaataaaataaaattttaaataaaataaaattttaaataaaataaaaataagctcaagcatgggaaagcattttgaacatggcaacctgttcctcttacttttaattctgtattatttggacattttttattttatacaatgtgaacacattgcctttttgaaactacatattcaaaaatattatatacacaaatatatgtacagagttatatacatgtttaggttttattcatccattcatttattttattttcctggctttctgtacaattttaaagtactgccctgccttcaagaaaagccagagacaagcaaataaagtttttttgcactgatcgggccaaaataactccagctttagaaattttgattcatttccctatgttctttcaagaagctctctgtggctatctacgatctcattcttcttcattccactccaaaagaatgaagattccaacgtatctcacagataagaacactgctgaatttagattcttgcttttattacatgaccttggacaacatgagtctccatcctgtttcttcctctctttctagatgtagatttcaatatctttattaagtttcaggtcagtcatgtccttgtttctccttccctttgctacaataaaaagtacttttccctgacaagtgtcagaattagaccaccaggtaggcgtcacatctatctcctcctccgagtccctttcagagtgtgtgtgtctcccatacaatgggagtaggatgatctttaggccttgtcctgcgaataggtcacattctctgcattagacagagctggtggccagataggaaacccccgtgagaccatctagacagaaaacgtgcaggcccccgattgctgtttcagccatgctcaagatttacttaaagacaatccaatgaagtgatcagaagatcaggccaaagtcagcggctgaacttgtaaaaatcattcagatcaacgctatttttatagaaactaaaaaaaaaaattaaactcctccaactttctttttttttttttttgagacagtttctctctgtcacccaggctggagtgcagtggcacaatctgcctcccaggttcaagtgattctcctgcctcagcctcccgagagtagctgggattacaggcacccaccaccatgcccatcttatttttgtatttttagtagagacggggtttcgccatgttggtcaggctggtctcgaactcctgacctcaggtgatgcacccaccttggcctcccaaagtgctgggattacaggtgtgagccaccacgcccggccaaactcctccaattttcttgtatctattgatgagttgggctaacacaaagagttgattagagcttgttactttgctcagcctgactgttccatccaacctactgctgtacacaaggtgtcctagctgggccaggggactctctgggggattgcctacagctcccaccagcattacctgtttgccatggcaaactttaagattgtcagcaagtaggatccaaacctaggcctgcacatctagagtggctgacaggagcctcatcactgagtgaagatgggaagctggagaatccaagaataataagaaagagtctggttcattagcccagactcagatggaagaggagaaggagaacggcagctccaggtgcagcacagtggctattatggaaaccggccacactgtgggaagaaagtgccaggtaaacaccctgaagagctctttcactagaggctgggacacaccagggcccggccaacattgctggagggcccctcccacattgctggagggccccctcccacattgtctgagcccctcccacattgctggagggcccctcccacagcaaaccccactcatgcactgggcacagtgctctggtggctctgtgatggctgagagcgtcagcagggaccctcagtctggcaatggagctgccactcaggagatgctgggctgcaaatacccacggacctccagcatggctgacaacagccaggacagcagctcagggcagcagcaaatgaagtgacctgcagggaccacacctgctcactccacagagcccagcctgcagggcccacacctgctcgctctacagagcccagggaaggtggcgtagggggaggggtctcccctgcctcctctgaagagcattcttaggtgaggcagaggcaaagcctctgggagctgctggtaagcgcaggcaagtgcaggctggcaggctaacatggcctgccatcatgggtacccccaggctgcaaggccaaggccgatgctccagtccagggagaaagtacagagtcagtgactcattgagttcactctgcccttcttccctcaggtcagacactcactcttccctacgccccacagatgcaccgcaagagtaagtggaggccaagccagcccgacactcagtcccctccgcttccgacctggtggcctgtgctgcctggttttccacaatggagttccgggtgagatttcctctaaagaaaaattgtgcttcgtggcacatgagtgtttaacaaacacgaacttcacatatagatgcacagaatgttaaagcacaatgggatttaagaggccatctaaccaaagtctcattttaccgatcagaaaactggggcccagagagaaaatgaagcccccagcccctcagccgtcagcatctgagctggcaccagaaccaggactcccgacttcctggagccactgctgtcctccgcccctcgttccccacgcactattcccttcacacactcatttccggaagggtgatgccccagcccctcgggttccagccccatgggctcaatcagcctccctcatttcttccacaaatgcaagcaagccactccctacttccctgccagaataaaatgccaaaaaccagagaactaagccccactccaggcggaagaagtgcagccccagcttactatcagataagtcgtttcctaaaaagaaatgcggctgcagtaaggcaggaaagccgggagccagggaccctgaggccagcccacctggcctcacttttcccaggaccacagtcagatacaacagcagggctgtggcccagccccccaacccttccaactcaggaaatgctgagcccccgtgagtgccagggagtgcccctgccatgcctcctctgaagagcattctggggtgaggcagggacctaggacagacaggcgtgctcagttagctcgagcgggatggaggctccaccggatgggatggccaggctcaggctagggtcgggggtgccaatgatccctcccagccgcctcagaagtggccaccctttggtgttctctgcggagttttggggtatgggtccccaggaactctcaggctgagggctccatgggaggaacaggcaacgtttccactccaacccagggtcctcattctatggaactgggcggggggagggggtgggtgggtaaagcagaagctcatagttgccagccggcccagacccgattcctggcatcaccccacttccaaagagcgtcgggaatggggggacagggatggggacgatgaacccaagagagagaaacactctgtgttcctccctgggcttgcctattcccgacttcgagtaatcatccaaaacaaggaaacctgccaggagatacattaagtctgtaagcgaagaagcctccaggcaaagagctgtcagtcacagggaaaacccaacacaatacatggattctactcctgttccgaggcaggggcggttcccgctcaaccttcccaccgcctcccccgccgcacaaacacagggacacaactgtgaaggcaaaaaaggatttgtttttcaaagtcaccaggaaaatcaacaccaagggaggcagagggagtgtggggccagtggctcctccttggataaaggaagcggggcggggggagggggttcagccctgggcctggacttcattccatgtccatgctccttgctgccaactgcaggtccgttcccaaagagtcacagccactagaatgctccaggccatctggccttcctctccaagacacgcaacatggaacgactccaggattctgtctttacacaccctggcgtcatccctttcttcactgaagagggggtccacacacgaggtcgggggcagctaggaactcatttcaagggtaggattcatacgctgctggtgacctaaagagatgggggccctagctggctcctccaccttcttcagaaagatcatcttacatctccaccagaaggaaggttcacccaccaacacagccaacttctggagagaagccagtggccagaaagcacacagtgagtgccccaagcgtggcatctgaagggctgaaaaagagtcctgtgggtcatgcctctggcttcctgcccagtgcaggcctccaggtatcgcagctaagaggctgccaggtctctgaataacgtctacagtgggaccctaccacggaacaaggcagcctgcccctctgctgaacaaggtttcatttcctcaagcccagtttctccggtgccacacaggagtcttccctttgctggactgcacagccttggccctcacatctgttttcttcctgacacctgcagtcctaaaaggtggacatcctgaaacacacaggcttgtccacttgaaggggttatatagggaagagaatggccaggccccaggaaagtgggaaatgcctgggaatgacaggcgtgccagcttgttttctctcacctcacagctcctcttacacaaaatctctgccatcggccaccatggccgaagcgatgctgagcgctcattctaaatgctggcatcggctcggaggaacgtcatggagagtgggtaagagcaccaggtcatgtgccactgcaggctggtggccccgatgcatccatcccacctgcaccagggcctgctgtgggctctgttccctctttaggggtgagcctggctctacatctcaagcctggatttttcaagcatcctttctgatttgatgctttcgatctcagggtcttcagctaatatttgctctccctgtgagtccacagagaaggtgagggaatagattcgtgtgtattataataacctctgaagttctttttaagcttctctgagaaatacattaccattactatcctggcttcaatttggtatatctataaaatgcattcacctgttacagtttaaggaaagtgcagcatgtgtcacaaatgctttgagggaagggaccacaagggatgctgacagcctccacataaacaggaagcccttccagggatgccacatggagctgtaagagagcaactgggactggccgccacagggtgaatgacaagttagaggagaactgcactttgtatgctggacatggcagctcatgcctataggcaggaggataacttgaggccaggagttcaagaccagcctgggccacatagcgagaccccgtttctataaaaaaaaaaaatttaaatttggccaggcacagtggctcacacctgtaatctcagcactttgggaggccaaggcaggcagatcacctgaggtcaggagttcaagatcagcctggacaacatggtgaaaccctgtctctactaaaaataaaaaaattagccagttgttgtgggacgtgcctgtaatcccagctactcaggaggctgaggcagagaatcacttgaacccaggaggcagaggttgcagtgagccaaaatcgtgccattgcactccagcctggatgacagagactccatctccaaaaaaataaaatgaaataaaaataaaaataaaaattagctaggtgtgatgctatgcacctgcagtccctgtacttgggagactgaggcagaaggatcgcttgagcccaggagttcgaggctgcactgagccatgatagtgccaccgcagtccagcctgggcaaagagaccctgtccaaaaaaaaaaaaaaaaaaaaaaaaaaaaaaaaaaaaaactgcaatgcactttgtagtttccaggactcttccatacactctcatgtctacacaccagctctgtgggggatgcatgatggccatcatttggcaaatgagaaaactgtggttccaagcattgcccttggccaaagccatgcgactagtaaattgtggggcaggaatgaaaactcagttctgagttttagaaagtaactgcttccaaactgcttccccatagcaggctctctcctaccctatgcagcggaaggggctcctatgccatccatctctgggtttctgagaacagaagggaagaagcagcagctcagagacacattcaggagaggggctgcaaatgcggggatcagcccaagaagatggcgctggggccaggatgtccagcagtgcccagccctggtcagagaccactgatccacagtttatgcaatgcactgccctttgcagtggtcctacgccctccaatgcacccccaactcaacccttcaatgaatgcgtccaactcagttttcatctgctccaccctctcaggcacatagcgacttctcttccccatgcacccaaggtgaaggccagtgttcccaggggccttgcctggggagcaggaggtgccaaccaagatatcacacctagagagcaagtcacagagtttttgccacagaccaaaaccacctaactgcagagctggaggacactcacagatcacctatggtgaccccttcaactcgcttaaggaaacaagctcagagatttgaactgactggccaaagtcacaaacagttcagtagcagcgcagaaattagatgccaggactccagaatctgtgttatttttttcttactccatattttatcttctaacgcagaagtctttgtttttgtttcttaacaggtgggtaaactgagccaccgagtgcttcagtgacttgcaggcgctgacacagtaggtggtagaaccaggcgctgggctcacgcctgtacagctcctaaggctacacgtgttctttccaatgcactctttaaatcctagagattacagcaccgcctttatgtcaatccctgctaaccgctggaatcctctaaggaagtgactcctgcccagagaaccagcagttctaaatggacttgctgcaaacactgaaacctaaacaaaagaggtctatttggcactcaaagtaataaacaaaataccaagaccataggagtgttccccaaacttacaaagatggcactcagtttgtataatggcatcaatgcagagaaatccctcctgggcttctcagaagctcttctggaggatagtggattagcagcatgctctagacagtgtctctctcaagtgctgggggaggaagtgaccctcgggcctcaccagtggagaccaagtccctgggaagcccaggccagctggaaaaggcagctgcccagcacagccaggctcaccaggcagatgtgctatgcacacacagacagacgcacaggagggcacacgtacacagctcatcacaccacacactacccacatctgtctacacccacacctcacagactgacccatacacaggcaaacacagacacaaacacacatgtgtgcacagcaggtggtcccttgtgtcccccaactacacataggcatcgacagacacccatatctcgcagatataaccccacgtgcacagaggcataaacacacaaaccacacatgcacctccccttgtcccttattgtcactgcagcctctcctgcctccctctttcagggaagctccagacacctgggctaacccagccctgaaggccctcataaatgccattcccagtgcaatgctttggggctggctccggaggcactgctcctgctgcccctggtcaataacaaagtctggagagaaaagtcaggaccatttatgatgggtcctaatgacaactgctcttggtaatggccagctctgcggtgacctaagtatgagctgattacaggctctggctcccgctctgcacacgcagaacacaggtgtcccgggggcactgaccgcagcagatggccccttccctgacggccaggacagctgtgctgacctcatcagccacctcccgagggctccttcaagtgggtggccctgagcaggcccagacccaacaggcaccaccctgagccctctcatacgggacgcggctccagggctcctctctccctcccaccctcactcagagactccctgtccaaaatgtctcaccactgatgtctgcagttctgccattaggacttcattatttgattaatgaggtctttgtcttcttctcctcctcttcctcgtcttttttttttttttttttttttttttttttttttttttgagatggagtcttgttctgtcacccaggctagaatgcagtggcgcgatctcggctcactgcaagctccacctcccaggttcacacctttctcctgcctcagcctcctgagtagctgggactacaggcgcccgccaccaggccccgctatttttttttgtatttttagtggagacggggtttccccatgttagccaggacggtctcgatctccggacctcatgatctgcccacctcagcctcccaaagtgctgggattacaggcatgagtcaccacgcccggccttttttgaggacttttttaaagatataagacagtcatgttttaaaataagttcccagtgtctctgtgttaccaacaaggccaaatctccattctgtaagaaagcagtcaggttgccgcacaagctggcttttgcctgttttgtcatcatttctagatactcaccaccacaccctgataagctagctaaccacaaagagattcgccactccccagtgcagcgtcgcagctcctggtctgatctccactgggattatcttcctaggcccacctttgctgcctgacaaatgcctaccagctccatggaggacagcacagggtctctcatctctgcagctccccttgaccatttccttggagaccagctcccttctgtatgctcccgtggctcccagctcttctctatcacgggcatctctgcatcccctgacctcctctagatggtaaggcctggtagagcagaaccacttcccaatcacaccccatgaccattttctggacactcaccagcgcggagcccagcacacacaccacgcagtcagccttgactgggtctctgacactaacatgaaattaggttaatccaggtgtttccttcccgaggcaggaaacaccatgaggagcagcacaaaggcactgtgatccagggctggagcacggacagaggcaccttggagaagcctgtgacaaacccaaagcttctgcctcaaacaggccccaggagtggggacagcgaggtaccctagtgtggccaggggcaccccaatacagacaccctcaccctctcctccaaaactcaccagctcctacgtggccagcccgaggctcactgcagggcttcccactcataacgcaacttcaaaagcaacacaccccaggcagaattacaccactaaaaacttccactcctggactcaggtgtgcaggtaagagctatctatagccaacagagttttcaccttccttacccagggcttaactcgggttcagagcacttggagggaggagacagctgcagaattctttgcagcgaagatcccatagcagccctttttggctttgtgtccccacccaaatctctctttgaactgtaatccccaggtgttgagggagagacctggtgggaggtgactggaccatagaggcagtttcccccatgctgttctcacgagagtgagttctcacaagagctgatggttttataaggggatcttcccccttcacttccttcacacactctcacctgccaccatataagatgtgcctgcttccctttatgccatgactgtaagtttcctgagatctccccagccatgtggacctgtgagtcaattaaacctcttttctttataaagtattcagtcttgtgtagtgtctttatagcagtgtgagaacaaactaatacaattatggagacttccctcttcccaggccctgggaagaaatgatatcaacacttctgtctacacagctaaaatctctttggatgttgattctagtcaacagatgtggtacagactaagcagggctcagtagaagcccaacgattgttgaatcatctctgcaagagtgcacgtcttctgcaggtggttagattttcaaaagaaaacacatgcacaaacacacatcatgagcctgtttttaaatgaatgtgtgttaagagtaaagaccctgtaaccagagaggctgggtgccggctggcatttggcactgtgcagacatctcagctcttagtgcctctacatctcagaacaaaggtcgagactccttctagccagccctgcatcctgtgagtggaagcagcggctgcgggttacgtggaggtgagaggctgctctcaagactcaagtcttgcctgtgcacttctcagcaccttccttgcccagggctgacaacaagtacttacctgactgaactccttcccctcacagctatgcactccctgggtgtcatatctgactcaggcccatggccacaaccacatgagggacccctgaaacacatgggccattcattccaactgctgcaccacaagaacaggtacagccttgctgggacctcgtcaccctttgagctgggtacacagacagctgcgaattggaaggagcagctccccctcccatgccttgatgcagcctttgagtccccacgctgtgggccagggctaagcagaacatagaatgcgaagcgagttgttataactgacaaatgacaaaccaacattctcctctgtatttatttaccagcttaggtttcgtcaattgaagaattactacttgttttgagtctttactccctttccctgtcctcatctcctgacaccaggaatgccctcctctactttctccattaatcttcagcctgacagttagatcctcatcttctctaggaaagttccctgaatttctccaggccccaccgaagacccctccctccttcagtcctgagtgctagaactacgcacaaaggcatctgaagttaccaaagagcagagacaaaaaagcatggcaaaggcctgtctcgcccaccagattcttgggggttttgtggggggttttgtttttgtttttgtttctgttttgagacaaggtcttgccctgtctcagacccaggctggagtgcagtggcctgaacacagctcactgcagcctcgacctcgcgggctcagacgcacatcccaccaagtagctgggaccacaatgtgccaccatatctggctactttttttttttttttttagagacagggtctggaactcctgggctcaagcaatcttcctgcctcagcctcccgaagcactgggattacaggcatgagccaccatacttggccaccagattcttaaatgtgtcgagggcaggaacagggtcctccatatggggctgagaccaaaggaaaagtggaaggcgcccagactgtctatgagcctgagaggtgagcacagcgggctggcacagccgccctatggagtaccacaggagggaatgcgctctctaggcaccagctgctctcagggtttaaagtgcttatccaggctcgtttctagctctggtgccaccgacatatagttggggatttccttcagccataagccattccccaaagctgaatgcatccattgcggaagacaccgacgtggaaaattttcaaagagctcacaaagagaagagaacacatctgaggtagtcccaaaaggaaatgtcctttggagaaagctgatggaagggctagagaaaacaagagagagaaaatccccctcgtaatcctgcctgaatgagaaagaacatcatttagggaagctggtttctcgttttctccccactgccaaagtactattttggcatctctttacaactcacagacatcctttcagaatttgtaaatgatgtcccttaattcctgccctacagaaaatacctctgttatgcctccaaatatctgccaagccagtaagcatctattacctgcacatcaatccctaagtgctgtcaaatagcctcagccctcatgcttacagccccccaaacctaacagaccaacaccttttacattcaagactcaaatatgtatatggaagctctgcacatgcaccgagatcccaaccccaaaagcccacacagacacaaatgtcaccttctctcaggagtccccagttcctgctcctgccgctttgaggagttgggatgagaaggacccagcgtgcagcatgagttatgggagctacccacaatcatctttaaactcagccctgcaggaagaaccccaaggctagtgtgatatggaaactccagcatctggagctggctgggactgtaagaacaagcagtttataatccagcagtctccctgaaaaaaccactatcaacaatcactacaggccagtgcagtggctcacgcctggaatctcagcactttgggaggccaaggagggcagatcacgaggtcaggagttcaagaccagcctggccaacatggtgaaaccccatctctactaaaaatacaaaaattagccaggcatggtggtgcgtgcctgtaatcccagctactcaggaggctgaggcaggagaattgcttgaacccaggaggcagaggttgcagtgagccaagatcacgcaactgcattccagtctgcgcaacagagggagactccgtctcaaaaaaaaagaaaaaaaaattagccgagcatggtggtgggcgcctgtaatcccaggtactcgggaggccgaggcagaaaaattccttgaacccagtaggcagaggttgcaatgagctaagatcacaccactgcacaccagcctcagcgacaagagcaagaggctgtctcaaaaaaaaaaaaaaattcactacagtaccttccctggaaagacctggaaggctgtatttcatctcgtccccatcatcaccattcatgtgtccatccaccctctcacttaaatatgcgctgcagcactcacagaactcaacttacctaattcccaaatgggtctctcacagccacccactagcaaagccagagacactgggggagtatctgcagcatttttttttttttgccactgtcattaacactcagcagaatccagaagatgacttcaccccctgccaccatgccctggccccagctcccagatcagtcaatacgtccagccccctgccaatgtggatcaacaaatgtctattttcaaagaaacctaagctggctgcttctggttcactttcctcataactcatcaccaactatttgtgggatgcggagggcaaccatcctgagcctgccccctttgaattaggaagtccccaggtgccagcagtaagaggcactcaaacccagggaggctcacgctacaggggtggctcttgcacacactgactatggggcaagtccctcttcttggtcacccagccagacagactgcagtccaggtcctctgggcacagtgggagtgacagcactagtggcaggccagaccccatacacagcaaagctgtagttcaaatatgtattatatgtgtctggctttcacacggagtttgcaacctgccagttagtagtgtttaccttggtaaaaattcacgggaaatcttagtctgaacaggcccagagtttattttactgccagataaacaactttctttgataaatcatccgtgtgacagtgttcctgaaagactaaacaaagatttcaagcacaatctataggcctttgagaagccttccaaagcgaaggcatgtttaattggctgccctaaggtcggggcagggcaatgatctgacatttctttggccatttgttcttctggaaaaaaaaaaaaaaacagattggggcttccagcacatttctgcaaaactggatgaaacttaccaatatttaaaagctcattcgcattataatgcatagcctattttttggttaaaggaagtgaatatcacaaggcaggtgttggggttggggtaggggaagggaaaagtgccccagagatatcgctggagaaaaatggagaacaaagtgaagtaaaacagcacaaaggggctctgaagtccctcaaacataggccctgctaaattaaaaggagaacgcgttaggtagagtgtttctaaaaaacacacaaatgaaaacttcagtggtcctatcctggaacaccaggcagtcacagctcccgcattcagccctcatcactgtctggaggcttccaggtttacgttgacataaggatgtcatctcactaaaacccagatctcctaacttctagttagggtttggctttccgagggggagttgtttgttattgttattgtgaattacagcaccttgaagctgcataaagcagttctctttgtgggttttgttttgtttttgagacagagtttcgctctatcacccaggctggagtgcagcagcgcaatctcagctcactgcaaccttggcctctaggttcaagtgattctcctgcctcggcctctgaagtagctgggattacaagcgcctgccaccatgcccagctaatttttgtatttttagtagagatggggtttcgccattttggccaggctggtcttgaacttctgacctcaggtgatccacccacctcagcctcccaaagtgctgggattacaggtgtgagtcaccgtgcccagcagcctaaagcttttaaaggtcttccaaatgggttttttaaaagacttcttcagtttaatcctccattaaccagagaattaactagcatattccattcttcttcctaaaaaactttccgcccaacaagctgatttcattagtgctggaattttccttcctaggctaaatttcatcctaaaacatttttttccaataagaagacataataattattacagattgaacagccaccatattccaggaactgtccacacttgattaaatccaattctcccaacacagtcacgtaggaattctcatccatagtttgctgatgaggagccaggctcagggaagttaagagactttctggtggtcgcttagcttatagggtagggatttaatccaagtctgtctcgcccagagcctgtgttctttccattctgctacactgccggctttcccaccaagaagggagccaatgattgctgagctccttccgtgtgctgggcacagacatcagtccatttaaattctacaaaccctaagagtaaaggagcacccgatgccccttcccaggaagctcctcaactaccttcctgcttgatgggtgtgagaggatgggaaggagcaagggtgtgcaatctggcctggatgccagggaagtgctggtgggcagtaacagggatccaggtagagtgctcttgggtcactgaatgcctaactcctttatttttttgtcttatttccttcagtcagtaacgtgagggcacggactggctgatctttgaggtcctatccaactcaacacagctttacaatggcaaagtggtacaggggcttgcttcagtagcacacatggtaaaactggaacaatacagagaagattcacatggccaccatgcaaggataacacgtgagttcgtgaagtgttccgtatttttaaagaataagatacagtcttcagtagcacagctaggcaattatagttaacaataatttattgtatatttcaaattaactagaagactagatttggaacatttccaacacaaagatcagtgtttcaggtggtagatatcccaattacacaatttttttttttgagacagtcttgctctgttgcccaggctggagtacagtggtgtgatcatggctcactatagcctcaaattcctgggttcaagcaatcctcccaccacagcctcccaagtagctgggactacaggtgcatgacaccatgcccagttaatatttaatttttaatggggatggggtttcactatgttgcctggggtcttgaggctggtctcaaactcctgacctcaagcaatcctcctgcctcaccctcccaaagcattgagattacagatgtgagacagcatgcccagccccaattacccagtttgatcattacacattggatgcttttatcaaaatatcaaacataccccataaatatgtgcaactattttgtatccattaaaaaaattttaagtggtacaggtgagcaacgcagcacccaaagaaatgggcagttcacatgagctgtgaacagccccctcatcccactcatcccttttccctctttctctacccacctccagaaaaacctcagaaaataaaggtgaacttgagggcaaatccttctctccactccccttcttatgagagtctatagtcatatccaaagatgaggacatgatgcataacacataagccagatgcaaaaggacaaacactggctcggcctccatctcttcaccgcctacccccccaaccccccacctcccatgcacaagaaggctgctcagaaagagacacaggctctcagctgggactcacacctctagtgcactaagcaatgggccaatctcaggtttttacgcacataaaatatcctaacaattagctccattttgtacagatctgtggatagaatatgtatcttcagcaacaataaaacccagttgttttccacctatcaattccatccccagagtaacaattccttccatgtctaattttactttgactgaatgagattctggatgttggggcttcttttaaacatgtatacatgtatatgctcagtcacccaaaacagggcatgtagttttccttgaacttaatacacaagttgccgacatccaccttgaaaagagccttctcctttataaaaaaaaaaaaaaaaaaaaaaaaaaagaagtccatcatgcctgcaatcccagcattttgggaggccaaggtagggggatcgcttgagcccggggggcggagattgcagtgaactgagatcatgcccctgtgctccagcccaggtagagcgagacttagtctcaaaaaaaaaaaaaaaaaaaaaattccaacatccacgtcccacatcccctgtcattcatacagtcagctgacaaactttcattttatgcctaccatgtataagacactgtgccagggactatttgagtgcaaataggccttactttgttcattccaagacacagattttctgcacatttctgcaagaagtatggtttttttattgttttttgttttgtcagtagtacaaactgaacagtgtgtctcacaattaacaggcatctcccaccaggtaaaacacggcattagatacagagcctgctctcaggcagcctgcaggtgccgcagtgactgtgctagcagccatcttgcttcatctttgggaggaaacccaaggtttagtttggaaaggctgagcctactttctgcaagaactcaaactgcccgtcagagtaaaacactgtcccccaaacagcagcacagccaagacatcctgaaagaagttggaggcagagtgagaacagattagtggaggtacggaggtgcgggaaactgaaaatatttctactaggaaatactccctaatgctaactgtgaaagctgatgttcttttccttcctatttgactaaccttagtgttgcatagtacagcttttctctttatgaggaaatatataaatggaaaaaagaatccttccagaaggcaaggaaagtttctaggggcaaagaaatccttttccatagggagaaaatactgggctgaagaaattgccacctgaactctcaagctcaaaacactgaagaaggtagtacaagtggaagctctgaactctcctagcagaagtgtatcaccatgcaaatttcccccaggaaagcttacgggtgtttacagatactgcagaagaagctagagaaagtggccagaggcaggaattaacctcaccacaattataaataaatcagatcctcatatccctgggataaaccaacccaaagggaagacggctgtgggtactgagctgttaacagcaggatgattagtgtggcggctcgcaaatactatattgggctatttaagaggcgagagtggcaccctgttgtcacagagcaggaaaagcagagagagaacaaaaagcagagccctgcaagctgatggaagccagcaggcaggctggtcgccatgttcgatgcggtgactttgccccatctaagtcttggctcccacatctggtgcttgatccaggctgatcagctgcattcctgagcatcagcacacaagcttttctgctcatgtttttttcctgttggggaaaaaatgtgccctgaactgagcaggtacagtgcagggctggagacatgagtgactaagcagatctgccaaggggttaaagcacactgcatgccgagaaggtcaggggtcagacatgcccagctccacagaggctcccggagaccacagatgcagtggcagggggacgagggtgctgcttacccagggaaatgcaccccttgttcccggagctcacagagagccttccagcaacctgatgtcttcccactggggatgtcagggccacttaatgcaaagtttgatccctggaggagggagtcaagcattctctttcttctctgctgtgtgtcagcttgcattgttcaatttctttgtttcctaactgaatcccatcagtgtggctgactgcctcacttacttgaagtgagctgagctaggaaacacgtttctcgacaaggctgcattctctaaggtgctaagaagggcagagctaagctcagcccctacagagagagagaaaaaaaaatccctatatattgttttatgagaacattacagacaaaaaaacaaaaaggtttctcctgcaaccagctcaaagaagcctgccatacaccatacgcacactaaggaggtcagcgcctccgtggcagagcccagcggctgtgcatcaactcttaagtgaggagggcaggtggcagagtgtaaaaggactccagttgagaaagtcaaattccttctttatcaaataagaggactggataagatgacctctgaggtccaggaggaacccaaaagttctgtgaacccaagaggaaaatattgtcagggctaaaggaacccaatcccaaacagctaatcactcagattccacaaaccgtgactggttatcgacatgagatcctctgtcctcttctgtgtacagaacgctggctgatttggcaggtgcctgctgccgtgggaagaagatgtccatcccagatgagttacctgagtgccctctagacccctgccctacaccttaaggtcaaccttgccagattcaaattctttcccaggcttgcctcttcagcctatgtggcaaagggtctgaatcctccaacttctgtcttttttaaaaaacaatactcatgtattacatttatttagaggaagagttccaccctcaatctgtatctatagaactcagaaagcactaggtatacagggaatcctcactgatgaatttgagttaatgcagaaacagacaagtaactcacactgctgcatcacagagaacacatcaatcttccccatgcatggaaacaggatacgcgctctccagtttagctctggtggccatctacatccagcttccatcttcatccacaattgcaataccctgagaatgaccctgtcgtgaggcatgattccctccgacttgcatgtgtcctcccacatgtgtgcagcttactttgacagggcaggaacaagacccttccgtgtactttaccatgttcgattaatgaaaacatggactgggatgcctccgaatggactcacatcacctatctttacgcttttccagataagaattctgtaagaaatccgatctcagggacacaaggcaggaattatgagaaacacgttgttcagcatcacactgagtcttctgaaagtgtggcttggccggagccacttctctgcatccatgtcagatagaggcgagagagagggagctggccctccaaaggggtgccgtttacatttacttttctcagaggagagactctcagggtgtggtgaattcaggtattctgcaggtcagactataacagaccatccctggaaggccccaaggcccctggcatctcccccacctccccctggcccccaccagctcctccttctcctggagctgcgagtgctggttcagaattctctttcgatggagagtgacttgggaagaagagagaaaaaccaccctgctgtggggatgtccatttttctttgcctcgcggaacctgatgaggacccccactctgaatcccctaagcattgaactctcccctccctgggaaggcacccagagggcagccatttaaatcctggacagagtcatgctgacacctaggggtagatgttaaaaaaaaaaaaaaaaaaaaagagccagtccggaaaaaaccgggcccaaccagacacagtagcaggtggcaacttgtactccctgcagcttctgagaaggagctgctgtccttccctgctcctctcgacctgtccccaaatcagcctccctgcatgcctagagaagatgcccaaaaatctgtccagcgatcccccacaaaggagggcaaagtatggccttcatcaaaactggccggttctggaccctgtctagtctcccatctgcctgagaaaagcagccatttggagaggaatgaggtagagaatatggaaagctgcaacgagatacatcagcagggcctccgtctggcagaggcacagaccaggaggttccaaaccttccagaggcagctagaaacgctttcttaccaaactcgctggcacagagatgttcaatgatggcctcagatttcaactcgttgtcacagggaggacacaccgttgtgcctgggaaaggaagtagggagaaacggaactgtaagttacagagcaggaagggagcagcccctggggaaaagatcggccctgggtccaggctgaaagtggctaaaggtcttctggaacttctgaaggggacctgagaattgaaaacaagaagccttgagcccagggtctacaaccagagcaggcgcaggtttcttgaaacattttggcccagagctgctaaatgtgacacagttatttaagccagcataacctgaggctgggtgggtgcaggtcacatgaatgatgacttgtggggcgctgtgagtgccgggaaaagctggcttacaaacccacagagatctcttcctggtgtttgtttcccatcctctcccttctcctttcaataccatcctccgattcctgcccccttcccatttccacactcccagctagcctgctgatccctctgaccaggtctccaggagccaagagagaaagaaactcagccagactcacaaactccagctctcggcccctgaacacctcctctccaaaagggccaccgcagcaggaggccagggcaggcgggcggggtggggcactaacaggcgctgccaaatgggaggacagggctggataggaaggggtccttcagaggctctttcctgggcaactgtgaagtgctttgaagaggaggtttgtgggggcagacgtgcataacgttggaaggcagctccactgcctgggaggagatgtctgaggccagggcagaagcctcctccaagccaatatactgctgaagtcagaaaatccagtggaggtaaaggactccagcttcccaggacagagggagagcaggacggcgctttcctccaagagctgaagtggcttatcatcattgtcatcaccttcacctatcaagcagcctggagcttatcgactgtctaggaaaacatcacgagcacattctaggggcaccccacccccgggcacagcacaggaggccaagccaggctggagctgaagagcacaggaaagtcaccgctgaccctgcactcggggagtgcaggtggggcttggtgtgcttggagcccactgctcttcatcctcctccaccatggcttccgtggcagcatctccctccccatcagccccccttatggctcagacattgaaataggcaaaggctccctaagtggaagagaagaggggacctgcagagcacccccagatcaaggctgccctcaggacacaagtggcccatagaccactccctacttccaaacagggtccctgcagggcccagcagagaccccatccttagtttttattgacacattcctctcccacctttactctgcacccaggagcaaacaccttccagattctcagtgcagttaagaaccacgctcccagcagacgatggcatgactgtccttagcccagatgctggaaatttgctttgcacccagaacttgagactgggttctagaggtggtaattctcacaaaggagacaacttaccacaaattttgcattatggtttttgcttccacatggggaaaaggaagtgtgacaatatggaaaggaccaggttacttgcacaaggagagtgaactgtgcttttgggttttccttgtttaggttattttgaaaaaggaaaagtgggagttacacaaacacacatagcaacgttctgtgaatacaatcttgaccaaatagtgaagtcagggtgatccaaacataaagggcacatctctgcccgctccacacactcactgcatctcctctggacacttgaagttcgcctgaaccaatcggccaaggagggctctgcacttctcagggacattttcctcagtcccgtcaattacatttggacttcagtgcctctcagaatggcaggagctcgttggggtgggctctgtgtgtttttaccacggctttcccctatctcagcttttctaacggctgactctggagcagcctgatccagagagagaaagagaaatgtgtgatgcggtattaacctgcgcctcattggtgcgtcttggggctctacaggctgcctctgcaggagaaatccacccagtcatccttctgagaggtggaactaaatcgctgttttcagttgtatttaaaataatgtttaaagcaaatgaacaaaaaaagcaaaggttttgtgtttattaatatttaagggtgtgtggaggagacagcccaacagctgaatcaggattaagtgatttttgtgatacatcaatccacacacacacaagtgctttctcagtctctctctctttcttctctctttccctttctcacacacaacccccacaatcttccctggccagttcctggggggaccaaaagggagccctaaggaaggctttctggggaacagagggctctgtggcctctgccacactgactaaatgcacaacatgcccaagcaacaacaaaatcaaacccaatgtgctggctcatacaacttcacccagtaaaaccaggcagagagggaaacaacaatgcatcagcctgggagttcacagttctaatggaagtgccaaattcaaaaatgacttccctagaaaaagagcaattgcctcttccctaacaggagcttctatggcttgggtatcagcctttgcaggggaaaaatgtcaagtcatttctcattatcaggtttctccttaataacacatgaccacagacagctggccaataatccaaaactgaatttgcccaagtgtgtgaacagaaaccagtatgcaaagatatgacactgctttgaaaatgcattttaattttaaagaataaaagcataaagaataaacgaataaaagagtagtgcatgcatacttattctcattggaaagtgccagttacgaccccacagccacaagccataaggttatgaggatcagtagtctggtttgtcttgacctgccctctacacacctacacacacacacacacacacacacacgccccaccctcccctccacagggacctcgcaggaaatcacgtggggctcccttacaccagggattgcagtcctggggagggtggtgtgccatctcagggcagagccccccaccaaaaccactgaggggaaaaccagtcccaagccccactcccgaccggccctctccccacttttctctttgctcctcaaagacctgtcttgggagggtgactacctgagcgctgctgggaggagtggaggtgagtgaggacggttccaagccaggctgagaagggcgccgaccagtggaactgcagccaaggggcaaaaggtgtccggaagacagcgattatggggtttccccatcccatcacagccttttgggggctggggtgagggattctttcctctcttcttcaggcaacccgtccaatccccccatgttccctgtggactgcagcaccttttccgcagccgagccccctaaggtgtccactcatgtctgcagacggtcccagaaagagaccatcggaagccattgggaatggactccaggtcagggctgggcacagcctcacagggcagggctgggctaatccccgctggctgaggaaggggagaaggaaattcccgcaggctgcaggggatgggtgcaagccaacagaacacaaggcgctttgtttgctccaggtaactgctcagttctcgctcacaaagtgcagatgcatccgctaccctcactccactcccaacaccagagttgactctgagagcagcggtgcccagacctggccactgcgggcaatcagtgccgttcccatccagccatccaacgacagtcactgtggacccatctccaccctccctagaataagcaaaagcatctaaaatttggggtatccctttcccccacctgcccaaatcctcactctgaggagccaggtgactgcactcccctcttttagcatcaataacagaggttaaagacactttaaggtgagctaagtgtaggcagtctttctcccccaccctaaaggccctcctcaaaaagccctcaggaagcctgcgtctgtgctaagcgcagctggggtacagctccccaatccctgaccctctccacacctcagagcctaaacttcgcttctaaagaattctgggttgaatttacttctatagaagtcaggtctgtgatgtgtatattttatctttatatctatttcattttatttgacttcccaggatttttttttcttccccctcaagaattgctctttaaacataagggggttttgagaggaacctcgggccggtccctcaggctgttaggaaagtctgcattttgcagagctgctctccccgggaggagatgaacaatgagctaattacatttttatctttctaatgagctgaggatttgtgtaaatgagaaaagcagggggtacgctagagggagggagaaaagactttccacccccagccctccgagggcagagctggtacctggaaggggtggagaaacagaagtccccacggttcctaaactttctcagccagttttgcagcaatcccaaggctacttgactgaatgaccagtgaaggaaagggcttggttttattttttaaatctttgtcgaacctatgaaaataaacaaaagctgctccaagcattctctcggcctttctgaactttctacgctttgggtttttgttttttcctcccgtctcagaggttaaaaacttcgatagggactcggagtcctcctagaggagagggaagctcccctgttatttaaagcgcaaggctttgtttcaggtatgggaaaggcgaagttggatcccaggaagagcggctccggggaccacagcgagtccctgcgaggccaaggcgcagagctgccgctcccgggccagccccgccgtgcacctgggtcgcgaggggcgctgagcgatacctgggacagaccagacgcgcttaggaatcacgtgcacagcatgcgagcaacctcgggccctcagtccccagcaccgggacccagcggcgggcgggcgtagggtggcgcgggttctcctgcagctccggccgggggatggagggggcggctcgcgcacgtgggaggaggcagccttaccttggggcttggaggcttcggtggcattgggcggcgtcatggcgatgcagacgtccccctcggggaacttgtcacacttaagcatctcgggccagtagaagccgaagaactgcatgaccggctcgcacgagtcgcgcacggcctcgcagagccagcgacacgggtagatgggccggtccaggcagacgggcgcgaagagcgagcagaggaagacctgggtgccggcgtggcagttcttgttgagcaggggcacccagctgctggcctgctgcttcacctccgccatggtctcgtgctccagcaggttgggcagcaccatcttcttgtagcccacgttgtggcacagccgcaggtccgcggggatgtccacgcactgaggtggcttggtgtagaagcgcccgctctggtacgggccgatgtccgactggaagctcacgtagtcgtactcgctggccgagcccacggccagaagcgccgcgcccagcgccagcagcacgcccagggctgccccgcggcggcccccctcgctgcgcccgatgcccatgccggctctgcgccctgttctccgcgacgtcggggctgcctccgccgcctccccgcgcgcgtcctgccgcaaacttccagggacctccggggacaaaaggcgcagtccccagcgttgcccggctccgcggccgcaagctgctgcccggtccccccggccagtggcggccctcggcctgcggtcggaggcggcgcgggcggggaggcggcgctgcgggctgggtgcgccccggctcccggaggtgcggcgagcaggaaggcgcggggcggcgggcgcgcggcactgactccggaggctgcagggctggagtgcgcggggctcctacggccgagccctcggagccgccccgcgcagccaatcagctcccggcggggcgagccgcactcgttaccacgtccgtcaccggcgcgggagccaatcgcctccctcgcgagcgggttcggtttactagaaccagacgcggctcaacaccccttaaaaaacaaaaccaaaaatacataaataaaagggggaggaggaaagagacaaggggagaaaaagaaggggaatggatcacggcgtggggtggagagagaccagggcggacgctgtaattaactcgcattggcttgcagagaagcggggagcctggatcatacttgcaaacccatgaaattatgaagactttttttttttgagacagtttcgctcttgttgcctaagctggagtgcaatggcgctatctccgctgactgcaacctccgcctcccgggttcaagcgattctcctgcctcagcctcccgagtagctgggattacagccgcgtgccaccatgcccccgctaattttttgtatttttagtagagacggggtttcaccatgttagccaggctggtctcgaactcctgacctcaggtgatgctcctgccttggcctcccaaactttttttttctttttctttacactgcttcctaatttcaaccaacagccctttagactagcggctcctctcctcggttctctagctgcggtgcagacaggtggtttcccaactaacaggggttcaggaaggctgaagcgagggaggtctgcttgtaaatacccagtgggcctggctgggctccctggaaggcgaggcgaaggcgcagttggagctgtttgctgtgagcagcacctctccaggtggggccgcccatggtggccctcaacactggggcagtgggtggactttgcccggtgtggcggcaggaagagctgctagcaacggtattagctctgggaggacacttttttaaatatataatatatatttaaatagaaaaaccctactcaagtcctagcccgggcgacagcacatctgtgtgtttgtggtgtggaaagccaaaacattaaaaacacatgtgcacttatcagcgtggctggtgtaaataccaagtccatcactcaggcacacatgctaaggttagacccagtccaggaacttcaagttaaaatcaagggtccccactagggcagacgccaagaggacggtatcagcacaacagctcggcccccaggaacagaagtctctctgccaccttctacctcgaattcctgagaattcttcgtaggtttcaaacattcccctgagagggagggttaagctctggagagctgggagtgagacccggactatcccgggacagaagaccacagcaaatagttcatgaagttcctggagtctccatatcttctgtccctaagtgcgggtggagagaggctgatatattcatagcccagtctgagcgcacaccccatgtggcaaaggggtcacagatcttagcgctccacagagacactatagggcgcgctgccttgcccgccagcttgtttgtaaagctctagggagcttgctttggactctgcaaacctaatttcttgatggacagattccaagtgaaatgactagagtttgtgaagaagcagggctgttttcttaaagcattcgtgcccgtacagacacggtgattccacggtgcacacaggaggcttctgcagatggatgacttctctgtcatttcgtggccaatggaagatgccttgacactcaaaaggtgacatggaggctggaaggaaaacacagagaagagagagcaagatcgggatggccaagggttaatcccaagacaattggtgaggccggcctgtggagctgaggaagacattcctcacagagaataagaccgcaggagacccggcaactgtgtctcaattcaaggggcatttagagaaaaatgctgtttggtagggggtctttttgtctcctagggccaggccctccacctcaagccaaatgcgtctgtttgctcactgcaaagatggatgtttgcagataacatcctctcacctctgaacccaggcttagctgaccgctcactcacgttttcagttttcccgaatggcaggaggacttgtgtctgtccacggttaaatgctggaaattcgtccaggtgactgccctggaagtcccaagtcaggagtaaatctcacaaatccattcaggggaagacctcgcctatgtctggtcactccgagtagactttgatcacctccagtcaccacctcccccactcacccctagtggtcctactgctttactgacccctgctgggaacacagttgtctctccgtggaacagggagtgatgggagaagaccccaaatcctaaatccagtgcactcctgactcctcccagacccagctggaaaggaaggaccctaagacctcagtcccaccgagagactttaatccattcctgggatgtgggagagggaccacccgccccccgtcctctcgggaaattcacatgctgcataacagcaccaggcagaacagcctgaagactttgtattgcagaggtacatacagtacttttgtccttttacttattgtcaactctttgcacttcaaaatccagtcccccttttcctaatggcaagtgtgtgtgtgtttgtgtgtgcacgcactcctgtgtgtacagcagaaggttctagaacaaaggccctttaaacatgcaactgacatgacagagctcccagatatgagggttcctgagtatgagaactgtgggccaggagacatatcctccctcctttttgaatggcttaaataaacagaggcaaaatgcagctttaacttatgtttctcatttcccagaagttctgcttttcccacactgctagatgcccatgcatgaagcctgaaagttcgtcctctgttgcttcaaaacaccagcttcaggaggcattctcagttcttcagcctccacagagggtcacagagggcccccccaggtgcctcccaggtggcctcttcccacacgcagagctttttcctggcttctcctggaaaaactgggaggggagccttcccagccacagctcccattgtgttccactatcatatcatcagtgatgtctgccatcctctccaaagatacattcagctcgctctccctcagccagcagcactagggagggagctcccgcctgaagctgggtatctgtgggtcaggggcaatgccaaggaaagcatgctggcccacagtcagtggacacaggctacagcctcagctctgctcctaactggctgggcgactcatgggaatcgcacttcctctctctggtcttagtgttctcatctgtgaaacagagctattaatgcctgcccggctgccctgctagctcagaagtgtgaattctcagcatgtagggtcactcgaggcacatccttagacttccaggcaagtctgaaggggccaaagtggtattcgttgtcagatgccttgaaacctggtcatgctcttacttggacaagcttcttctgcattctgcctctgtagatgtgtaatcctgatcctttctaactctttaaagaactggcctgacctgctaactgaagtctgggaatgtctgggaagcatcttaaaaatttggagttgaaggcaaattccagccccatctcttcatctcttcttagagtaagcacccctacctcttcatcttttttttttttttttttttgatacagagtctcactctgttccccaggctggagcgcagtggcaggaccttggctcactgcagccttgacctcctgggctcaggcaatcctgccacctcagcctcccaagtagctgggactccagatgcaggccaccacacctagcttttttttttttttttttttttttttttttttgagcaatgggattttgctatgttatccaggctggttttgaactcctagccccaagcaatcctcctgtctcagcctcccagagtgttgggattacaggggtgagccaccgcacccagtcctctgcaccattcttgacagaagctaacggagcatcccttttatttgtttgggatatagtcaccaagttcagacaatccactagaatgttcttccttccttgaagggaaactctgctccctgtaatttcttactaggccatcctaggatcagttcctatcgtaagcagccaggaagacaccctcagcggagccccaaactgggaggccaaggtcaccgtccccgcccctccactcagacagtcacacctgcccactctccaggcgaggttctgtcaaactgggcttgacaatttttgttcatttattactacattaattaatttataatttatattataaatatattcatgcctataaatataatttttatataaataaatgaagacttgtataccacctcttagaaagaagagaactaaaaataaaaggcatattttaagatgactttttaaatagaaataaaaatatcaaatggactatttctctgattaaaattctcacacactctttgtccacaggaaaaagcccaacctccaggatagtatcaagactcagccctgacccccatgacctctccagcttcacctccccagcaccccccaccagcctagtttccagtctccagaagtacttgcactttcccacccaatggcttctcgcttgcctctcatcctgggctcatgctgtgtgcacatgctgttttctctatctgtaatgcctttcactacttttgtacaaactactactcatagggtttccagatttacaaataaaaatacaggacacccatggccaggcacagtggctcatacctgtaatcccagcacttagggaaagtaaggcaggaggattgcttgaggccaggagtttgagaccagcccgggcaacatagcaagaccctgtttctacacataataataatttttaagaattatctgattaggcacaattttaagaattttaagaattagctgattaagaattagctacaggcacagtggtacgtgccggtagtcccagctacttaggaggctgaggcaggaggatcgcttgagcccaggagttggaggctgcagtgagctatgatcataccactgcactccagcttgggtgacagaatggcaccctgtctttaaaaataaaaattaaatttaaatattaaaaaatagaacatccagtaaaatttgaattccagatcaacaagaaaaaacttattaagtgtgtctcaaatattacctgagacatacatatactataaattattcattgttgaactgaaattcagtttactgggcatcatatattttatctggcaaatccacccacttatcctaacaatgttgtctcctccaggaagccaggcctgacctcctccatccctagtcagattcacccactctgtgcctgcagacactccgtgtacatttataactggtcccttccatgtacatcgtacagtgcagtgagctcttagaggccaggaccttgtcttattttgtcttacccattccacatctccagcatctagtacaatgccatgcatatactgagtgctcaataattacgcccaccccaacaaacaaataaaggggagacagacatgtgaaatacccaggttcttaggggtgctacccttgcacattgattttgtgcgatgttttctgagaacaaaggtaatacgccagcatgaatagctcccatcgttctctttgtctttgaaaaaggaaaatcttttctagatctgaatcctaagggaactgatcatcagtgccttatacaaggacagcaaacatagtgtgggacttctttattggatctcttcccatcccagagctgaccctgtggacagatgccacatccgattcactcctctctccccagggcttgcaccgagcaggtggctccatggagggtgggttggtcaatgcagtggcccattcccacaaatcctcacacaatgctgtataaaaacaggagctggcatctgggaggctagagtttctgggagccttgtatgccaagtgggggtggggactggggagcaagagaaggtagaagggggctccacagtgtgacacctggagtcggatcctggcgacggggctcaaggcttggctgggacatcacagagcaccagacacaggtctttaggaagcccctgcccctctgggaatcccaggcaagtgaaagtgaagtggcacatgcttcagtgacctgaagcccataaatctgccgggatggctgcggggagggcagcggcccagcgccgggacacattccccgaggagccatgtgcttatttacctaacccttcaaggcagtggagccagacggtgcatagccttcattgggggattgagcctggagcaagccggatataaatgaggtgctagcgagaggaacgggggagtgcccatcatcacactcctgcctggcaggaaagccttccctgctcccaagaactggtaacctcagctggggaagcctcgcctccaagtctccatccaggcaagcctcctccccacagtctctctcagcctgaataacacatctgccatctgccatttaaggggcattactcacctgggcgaaggcagaatcccctgtcgcataggaagatgccttgctgcagtcttttccgatttgctctctgcatgcattatggcatttgggcctcaccaaaagcttctgagctggctgagaagttcattactttcatttgacagaagaagatacagaagctcagggtagtgggaccctgactagcagtccagccaccaaagcactgtggtggaggccagtcgcaggtcaggaagcacagatctttggactccaaatcctgctggctttgcagtagacctggctttgctgaaggccagtccctggggagagaaacctggagagcccttgcagccagcaacatctgattgtccattcatttaccaggctctcttcctggacctccaccagagactgtacaaggtgcacaaaaacgtgagccacgcatgtcagacccgtgaccgctacaagaagatggcctgagacgtggcccaggaattgaagaaagacactttcagttttcagagagagagagatccttttctatgagaaaatgtcccaggaaggctggatggccactgagcccactgagagagcgctgcaggtgctccagaaagaaaatggccacaacaggcagaagctggctgactccaaggccgtttcaggctttcctgagtggcactttggcccctagggctccacccacagcccacaggggcctggaagtgccagggggactgtgagccttcagggctcccaggagggaggcgggtcacaatgccagggtttgggtccagagcacctgccagtttgattctgttttcccataaccaagtcctgaatgcccagagactcggcacaacgtcagccggtgctcctccctttaaagcacttttgatggatcccctgttagtttagctactgttcattagttcctgctgaaattgctgtcattgatgtttgatagatagcattaggactgtaaggtactattttccaaataaagattgtttaatataaaatatatatgtattttatattatatatattttataacataatatatatgtgtatatagaaagcccaatatggcatggcaccaaccaatcagattgcatgcagacaaaaaaaacctcctttgcagcctgacaggtgcatgccagtggggtcccagtgtgggggaattcatagcctccagcctctgtgcagagctcacgctgcccccacaagctgggccgtcttcccagcacacatctcaggtttggctaatgggcttcatctgcctggtctctccccagtctccctgtacatcatggctgtcagagcaccactcttcttgttttgcatgtttgcatgtccggagttctagaagcttcttgaagacagaatctgtatcttttttgtatttgtatctctagtgcctgccacatggtaggtgtgcagtagtcatgtgattgctgagcaaatcaccgtctcaagactcatctttttcatttgattgtctcaatactctgtacttagggcacctgaggaaccactctgtgacttgtctcctcttctgaaaagtaggggttctgccaggcgcagtggctcacacctgtaatcccagcactttgggaggctgaggcaggtggatcacccaaggtcaggagttcaagaccagcctgggcaacatggcaaaaccccgtctctactaaaaatacaaaaattatccaggtgtggtggcaggtgcctgtaattccggctactcgggaggctgaggcaggagaatcacttgaacctgggagacagaggttgcaatgagccgagatcgcaccactgcactccagcctgggcaacagagcaagactccttctaaaacaaaaattaaataaataaaaataaatggaaaaagtgggggttcataggacccttccagtaggaggctaaacagagggatgcagagcaatgtgggtgcatggatgagacaaactggggcctcctggagaaagggtgtcctgcaacctaggaactggaacaggaggaaggtgtcaaacttcccggtatgtggaagagttgctcaagatgggtttcctcagtcttaaataggcattggattcacctaggaatcttgttaaaatgcaaattatgattgagtaggtccgaggggggctactaaaaattagaacctccatgacagatgattctaatttttactgtctcctacaactttgctcctccaagtgtggtccgcagaccagcagcaccagcatcttctgggaacttgttagaaatgcaaatctcaagccagctctggccagtgagaaggaggtagaagttggtaagtgtggcaccctggagcacatcataagaaagatagccttagagattttgcctcttccctctgcttcccacctggaatttagctgtgatgcctgaggtacagcagctctctggcaaccatgaggatgaatgccagcagaccagtatggtggagcagaaggaaagaacctgggtctcaaggagtccctgcaccagccctgcactgcccacctggggattctcactggggagacctataatctgtctccctcacttgcttaaatccaaagtcattttgattttctctttcatgcagctaaaaccaaacctcactggcacaggtatgtaattctcacaataggcaggaagctcaaagactgcaggttctaatttttactgtctcctaagactttgctactcaaaatgtggtccccagaccagcagcatcagcatcttctaggaccttaacagaaatgcagacactcagcccacccgccgcccaccccaggcataacaattagtgtttgcattttaacaagactcctaggtgaatccgatgcctgtttaagactgagaaaccccatcttcagaaactcctccatgaacctggaagtttgcacatcttcctcctgttccgattcctatggctgtggagcacccttttttctgttgtccctatttgtgttctgtctcacccatgaacctgcatcgctctgtagccctctgtttagcctcccactggaagggtcctatgagcccccacttttcagaagaggagaccaagtcacaaagaggttcctcagatgccccaaggacagagcattgagacaatcaaatgaaataaagttctcaggcagaaagagtggacaaagcaactctcttaaggacacaggcgccaggagggtgggggcaggtcacaaagtaaaagtgcaggcagtgaggaaacgctgcctcttggcccctcagaggctgacggcagcagcagaacagactttgctttcttccccacacgtggtggcaccagcagctgtgtatctggaggcttctgtaatcttccagcagtttcccattcaatcatatttaatatctgtccctataaaaacattgccttttatcaaattcttctaacacagcattataagacagccatggctcccccacccagaaaagcacaatttgtccatcgaacccatttgttctttattttttaacagcagtctaggccactgaattgcttaatacacggtaggaaggtccataaataacaacttcccatggagatccacttagccttggagtgctttccaagttctgcattaagtcctctggtgtgaagggttttccagccatttaggtccataaatatatataaccggctgcttcctaaattgctgcataatccttaccaccatcacttatgttttcttttattgccattatcattggcctcttgacaggagaataaaatattctttctggaagatgaaatgctctacatcctgcacattttaactcatccagattctttttggttttatttccgtccccaccccaaggaaatcgactcttcacaattaatggggatttcagattggagtttaattgcatcctctctctgctgctgacacagccttggccggtggcaggcactgtctgagctgtgttctcccagttccagaagtcaatgaatcaacaggtgtctatcaatcaactgctgtgtgcaggttctgtgctgggtcacgtgaggaaaagagaacatcaaagatagattcccaaccccaagaagcacaaaggtgggaaggaaagataacataaaggatagcagggaagataacagagcccatggctggggagagtggaggtgggaagagtttggactgaggggatgtcacagccagtcaggacagcatgcttcttcttagtagatctatctgcccacactttgtctggcaacccagagaaaccaacagacatgagatggacatggccccagaaccaacccactaggaccccacctcaatccctctgtggagtatgttgcccataccccacaggacagagtgggtgacagcgctcactctctctccctctcactttctcttcctccctctctttcctccctccctctctcttcccccccccgcttctctctccttctttctcttcctctccctccttgttctctccctttctacccccctctccttctctccctcattctttccctccttcttttccctacctccctctcttcctctctcccccacctccctctctttctctctctccctctctcccccatctccttctctccccctccctcttacctccttctctcttcctctctctctccctctctctcttcctctctccttttctcccccctcacccacctctatcatttttgttcatgtcccacaaactattctgaacaagcaggctttgagccttctgatatttctccccaagtctgggtgggggttgttaatgagaggaagcacacttgtaatcaataagcggtggagccaggcagccctaacacccaagaaaggagagagcactctgaagaatgagctcatgcagcctgtgaccagggcagtcatacttgcaaacctctgtcttgttagaaaagacacctgagccaggacagctacaccctgccttccctccttcctcaccttcagcctctctaaggtgaagggcagtcctggatgcagccctcgctttgcaaaacacaggagcgagaagtagggacccagagactcacacaaacccctgctccctacttaaaagggcactgataatgaatgcctgcatgcagcctctctgtctgcaagccgctctcccacttatctctcacacatcatatttctcaaggttcgggcatcactgaccctagaatgagagatctgcaggctgctcaaaacaagccccatgactctccgtcctctggaggagactgttcctgccaggaaggggctgcagaggagaaggagctgcagacatatgtggcacaatcaatgcaggaggcaggggcagcggtccccgtcacagagaagtcaccgaccacctctggccttcccctagcctccaggctgccctcgtcactgtggtcctcatgccccatttccactgctggccctctccccagactcttggtcaccctcaactcctctcccatccacatcgggtgccagatggggtgccttcccatggctggcttcaggaactcttctcccctctggggtggggaccggtggggctggagagcagagggcttggtggggcggcgggggcagggccgggggtcgcagtggtctatggaatgcagacctctgcccacactcaggggccagcccaaagggcataatagaatacattagtccccagagccattcagccctgcctctttaagaacaatggtggcaactgagctaatttttgccaaatgactggcttccgtccattgggagcagagtggagcccaccagacaaagtccatattcagggcttcaagaggggctggctggtcggcactggggcactgggctacttcccaggaccagcaaccagagcatcccagtgcccaggaaagggcctgaagctgacaccagccactcaggccatctgtcccggggcgtgggggtgaagctgccactgaaaacgggaagcacactcttcgttttcaatacaagagagccttggtgcagtggttgactacagaacagtctttattatttggaggttcacttaggaaaaaccaacttggctgctggaagggaaagatgctcatgtcaacctatgtgaggcacctgcaatcagggaaagagcactgggctaggagtctggttttctagcctcagtggccttccacaatctcttctcctctctgagtcacaggtcctaaacatgtgaagggattgggctagataggctcatgtcctttgtaactttgatgttttatgtaaaaagaaaagtcagaccatgcttcctatgtgtctcatagtacattgctaagcattcaaaaaataaaggcttttggaaggaaggaaggaaggaaggaagggagggagggagggagggggaggggaggggaggggagagagagaggagggaatgtttatggagaatatgggatagaaatatatagtatgaatccaattttgcagacagaacagaaggataagaaagagaaaggagggaagaagggaaggaaggaaagaagaaaaaaagctaaaaatcctggaaataggtacactgaaatgttagccacctctgggttttgagattataggtgctttacactgtcttctttctgcttttcttcattttcagaaattttcacaatgaccatatatcacctttgcaaagaaataaagattattaattttaaagaaaaagagatagatacatagaacagcatcagtattctcttgggtggaagaaaaaatgtgtgtctctggtgttaacctctgtgacgcacgttcttaaaaatcctacttcatctgatgtgtcaggtaatgattgcaaaagacttggggtggggggtgcaggatggctcacattttctggataattgcccccattgtccagcttgtgatgcatgtggagtcatattctctatctttcttccagaccacacagacaccaacaagggagtgagaactttcaggccaacaatcaatcagcaaatgtttaatgagctcctactatgtgcaaggttctgtgctcagagcgtgtcctctcgtgctctccctcgctctcaccagctggctcatacacacgccctcctctatgctccatcttcctctcaccatcacagtcagctttccctgggcctcctgcacacaccccctgagcatctattcattgaaccacgtgccccaccaaagagaagagaatcagagccttttccacctgccctacctctggacagggatgcataggagggctgaaactggcatagagaggttgaacagcctgccccaggtcttacagcaagtcacaggtggacaccaggcctccagacctcctcccagctggctctctgggctcctccaccctcctggccctcctgagcatagaacaagcactgcctgaggcagccaggccgggaggagagcttggaaggtcatatacctgtcattctgggagagtgcttggcagctgctccttccagcctgcaggaattcatcctgcaataacttgccacacaagacacacctttcccgtttggactggacgctgtcccaggacaggagggaggtggagggctgccttgggtgctgcagagagcacccgacctcctccctggagatgcctagaggtgtttgttctcaggaaatgttggtcaagctgcgtgtcacctgataagagaggagagacagagagctgggtggttcagacatcgggaagtgtgtggggacatgaggcaggatccagcagggctggattttctgcaaagctaacaaggctcagggcagaagtgcagcaactgggagcaggagtcctggctccaagtcgaatgcagcctcagctcaccaggagggcatcagcatgcgagtgttgagcctagttccacagagacttctctgtcccatcccaggccctgtggttctgcttctagctcctcttccttcctcttcccctgtgtcaaaatccttttgatgtccccatcagcaccatccccaggaaacgtcagcctaagcagagatggccagaagagaccagtgtctttccttctttgcagccccacctgtgtgcttcaggtctttacaccagtgaatctctgtgcagcccatctcctggggttctgatgaggagccctccaaccatgcgtggtgcttcccatctctctccctccacacttcccagggagcaggagaatattaaccagaagtacagtagcatggcccccgagctcccagctgagcccagcagcaggggaacctacagttgtagggagggtgcaacattccccaaaaggaagcacaatgccccacctcccagagacagccaacccttgcagaacatgctgtcttaacaaaattattgcatttccagccttttagtcactcattcagctcctaagtgctgggccccagggaatcaaagcagacagagacagatccattctcaagatagccccagctcctggaggagacctcactgggctgtcctcaagtggaagcaagatccgattctgatgattaagatttgttgagtgtctgctttgtgtcagatgcccgggcacggtttatacacacactggcacaatgtcatcttctcagcaagtctgtcagggaagtcagttctaaagaaaccgaaggtaagacattaagcaatttgcccaaaggctaagaaatagaaaaaccgagtgccaggactcagaagacctttgatgggacatggtagcagtggtggggtgggtggaggaggggagatgctggatcgaaaggatgacagggctttttgagcgtaccaggtcctgcgtcaccaggcgggagctcttcacagtcccactggaccaccccatgcccaggaaacaaaggctcttgttaggatgggtgtcgctcaaccactctttgccaggaaagtcgccccaccccaccccatcccatcccctggcccagcaaaggaccacggtgccctctgcattttttaaacagctgtggccacatagcaggctgactctttgcatgaggggcacagaggacgtttgggaactgctttccactctccaagtctcctccctttctgtctgtctttcattccccctctttaaaaagaaagcaaggtctctatcgtagcctattgtgtgtgcgatgcctggccactggttttttccgccctgtctcattaagatggatggggttgctgccttattaataattgggaaggttcccctttgttcctctttcctctcctcgctaacgatcctgccccagaggctccatagagagccaggcagcccccgagctaagcagagcacctctgtgctgctcaggcactgctgccaagccaggtccggcccagccagagcatcccacccagggagacagtctcggcgctctcagctgcagatctagtgagccacagaaggaaagactagaagtgaccagagattgtgtcatccaaccagaaggagactgatgcacctgcctaaggtcacccagaggatggagtcaagaaacccaagtcctggtcctgggtctacccacagcccctctctccagtgctccatcctttgcccttctcactgtcctcctccaaacacagcctaaaagcagcacaactaaagtgttttcctgtggctacttcgctaacccattcactcatgtgcgttggttttcatgctagggcaaaagagacttcattcattcatttgcttcattcaacacatatttttgagggtctaccatgtggcagatgccgtttcaggcactggggcagcagcagagagcaaggtgggcaagtgtgctctctctcggcattcactttccaatagagtcagacaagaaaaaacacataaacacagaaacacggaaacaagaatttctaagaaagcgggaaagaagtcaaacagcatgattacgcctagagggcttagatcagggatggcctccctgaagacgtgacatttagcttgagacctgaaggaggagtctaagacaattccagctccccaaagagagcctaaagtccttgagagctggaatatcttgaggggaacaattggggaaagagtaggcattaagttgtgtgggtctgaagcatagctggacttggctggaagtttcagaaaaaggcagaacctaagatgggttacatctggcttgtcaaagaaaaggttgctgggtgttccctatggggcaatggctacagccaggacaagggtcccagcacagtatgtgacaactgcttgcctctttttctcttttttctttctttttttttaagagacaagatctcctctgttgcccagactggagtgcagtggaatgatcatagctcactggagcctcgacctcctgggactcctggactcaagtgattctcccacctcagcctcctgagtagctaggactacaggtgcacaccaacaagcccagctaatttttaaggtttttgtagggacgaggtctcaccatgttgcccagggtggcaactccaactctgggactcaaatgatgttcctaccttggccccccaaagcactgagattacaggtttgagccaccatgcccagcaactgtttacctctttgtcctaagtccctaactgatgtgtctgggcattatagtaattcttttcaccccaatcctacagttctctttccagataaatgggacctaatctggggtgcagggggtagtcagagaagagttctcaaatgagggcaacttgtgggtctgtctggcctctggatcctggcttttctcaatcagtcccaacctgtaaccacagagcccaggttaacagagacaagtaacataggtaggaacatcagacaaaggaggacttcctaagagaggggtggaggccccaccaacttgccagtagtttgtgaaagattttggctgtataaatcatgttctgtttgcaagtttagacttctccaggcctgccctctctccagcatgggctcccgcaccctcccactccgccacctcttgcagagaagatgggtgcctgttcccagaatacactcccaagttcttcaatgggcacagagtcccatctgcctctgcctgccccacttccccaaaaatgaacataatgaaaagagagatactttctataatgctacttgatcttcttgaagccaacctgactttatgccctgggtttgtaaactaaagcctattcatacagccagatgagacaaggacctctctgctcatgggatccccctgtttgagggatttccaccccaaatccccctcccccactgctgccatgtcaagaagattaatgccttgctccaacctgtgaaggggaggctgggctgtcaccgaccttgcagggaaagccaactttgtttgcatgggcatgggagagcgtggctgaccccaagcgtgcatgtgcacacacacatatatgcacacacagacacatacacacacgcacacacgcagacacacatacacacacacatgcacacacacatatacacacatacatatgcacacacatacacatacacacatgcacacacatacacacatgcactcccatacacacatgcacacacatatacacacgcacacatacacacatgcatgcatacacatgcacacagacatgcacagacacacatgtacacatacgcacacacacgcgcacacacacacgcacacaggcacacatgcacacaggcacacatgcacacagacacacagacacacaggcacacacatacatgcacatgtgtgctcgcgtacacacacacccccccgcccctcctgggacccaccaggggaggcttgtattctcaattcagttttagggccacagcaaaatttaccatggcacccatgtggagaaattagatggatcctctgttatacctgagagggagcaggtctcatcttgaggagacctgggcacaatgtgaatgagtgaaccctacaaaggtagttgccctccacagcacttcttttggttctagtccctaaatttactgatgagaaagaagaatgaatttgacagccttgtacagtgtgcctgacttgcaccaagcacctcgctgggcatgggtgcagcagtggatggggcactgctccttttacagccagctgccccgccctggcctgggctcacagcctttcctggtgccactccactttgctctcccgcctccgggtctgattggcttttttcactccaatcccaccacctgggtagcattttaaatggtatttccggccatgcacagtggctcacacctgtaatcccagcactttgggaggccaaggcgggcaggtcacctgaggccaggagttctagaccagcctggccaacatggtgaaatcccatctctactaaaaatacaaaaattagccagatatggtggcacacacctatagtcccagctacttgggagactgaggcaggagaatcgcttgaacccagcaggcagaggttgtggtgagccgagatcatgccactgcactccagtctgggtgacagagcgagactcagtctcaaaaaaagaaattaattaattaaaaataaataaataaatgtcatttccacctcataaccttgtcataatcacaacagggaaagtgaaggctggctgagtccgcactcaacctctctccaattcctgcccatctccctaaatcctccttcatttgattcttaatactatttacatatgtttcagagcaggtttccacagcctaaaatggcaataatcctagtaacatataagtaggttttaatgcatttaaataagattacacgttgaaaaacataacgacgcctgacaacaatacccctcacctgcaaaatggtagctgtgcttgttcttcttgctggattgcagaacgcttcttgctggattgcagtaactgaggtgtgtttacctttattcctgcagccccagccgcagcttggacctttgcacagatgcttgataattgtttgttagaagtcctccatatccattcagttctgggtgctaatccctcaaaagctggcagcaacagggtttgctaacctaaggaattcatttgcgctgagacactgtggtctcaacagttcccaacgttgatacatttgcatgctggggctttgtaatctaaaccaaaagaatgtttcgtagtgaccatttaaggcattggggtagtgggagtagggtagaataattattgtggaaaaaatacctattggtactcatgaaagtacccttagaagtaagctagcccggggtcccacatgacagccatgactgggacatttacatttgccaggctgtgccgctcagtgtcgctggcaaagtttaattatctccaattttgcctcccagaggctctggaactttcttctggccaatgtttttcttgcttaaaacccaatgtccctgggtcacctggccacgccaggtgctgcaagcattggattcacaccttgatgtgtgtggtactgggaggccacgctgtcaaaagcacatagcagaaaggggagggtgccaccaggaaggggagtgagaggctggccctgcctggccagcaaggactccaggttcctgggtcggggacaagagtgggtgtgcattccccatggggcatctgataaggccatgaaggtcccatgctgtggtctctgccaacatagccatcccaaagctcagctctgggtgtgccacatgcttacccagaaggcttgagtgggtcctgatgcctcctgcaccacatcctgacttcggggccctctgcggcttggctccaatggtccctccagcttcccttcccactcattcctgctccatggccaaatcaaacaactcaccttgccctaaacagccacaaggcttcccaccttcccacctttccccttgctgtttctctttcttggaaggcaaatcctgtcacctccatcatttgaaatcccctcgcttgtccctccaggttcaaatcaatggccccctctgcctgatcaacattggcaggaccccttctctgtacccataactgtgtgtgctctgttgtgtggcctgctggttttctactttgtttcatacatgcatttgtcttctttcccttcctggattggaaactctgaaagagcaaggagctggtcttgtatatttccccccacagcacttgcacaatgtgctagttggttggaaagatggatggatggatggatggatggatggatggatgggtggatgggtggatgggtaagtggatagatggatggatgggtggatgggtggatgggtgggtgggtggatggatggatggatggatggatggatggacggatgaacagaaggatggatggaagaagggagaaagggaaaggaagagggagaaatgaaggaataaacaaaaatgagcgaaaaaacagaaggcccctgattgtggtgctctgccagctcctcatgagtagccagagaggccgggctccctggagacgaggcaataaaagcgcacaccatctctgaatggcttcctcctcccctgctcccttccctggggcctgccttcagcagcattcgtcacacaggcctgtgatcattgaggaaaaaacatgcaaaggcagagcaggggtggccctgccccgtgaaatcctcttgttcaagggccgctgtccccacaggaaatcagtgaggaaaggaccaacctgctgggcccctttattccctggccccaacaccccggaagctaactgcgaccacacacagcaggagacacacacaatcccctccgccagggggtctctggttagcaccagcgtcaacaaatcctccatactgcacagacacacaaatgtccagccgcaagccgatgccggaaacaagaacaaaagccacattcaacaaggaggcttcagttaaccagaactctggccgacggaatcttcacttcattgaggtttttgtttgtgtttttgtttgttctgctttccatctcagtgccctctctggaagaaaaagagaaaccatccagaaaacaagctgacattaaaatgcaggcaagaagagttccagaaaaaaaaaaaaaaaaaaaaactgggggagcctttagcatctggagtttcagtgacaattttagcaaaagcagcacaagtaattatctcccaaattagcgaacacagctatttgcatgtccaggctgccctaagcctgtgtctacaagttggaggttgcctgtgtttgtggattgattgacccagttccctaaccccacaccaaacaatccctggtggtctgtcttctgttgcttactttccttttcctggtaactgaaaaatgcggagagtgtcgtgcctaaagccatctgctggtcatcacttgcctactgcggcacactgagcatgagcactggcgtccagcagacaggcatttcctctcctgggaccttggcaagtccctgaatgacacagcctcagggtcccctccgtgaagtggagaggatgataccacacccctctcaggttgcttgaggactcaaagagggcacttcacaccagcgccctgtcagggacccacagtggttatgttctttctttcgtttatttactttttcgaagacagggtctgtcgcccagtctggagtgctgtggtgtgatcatacctcactgtagcctcaaacttctgatctcaagcgatcctcttgcctcagcctcccaagtagctgagaccacaggcgtgcgccaccatgcccagctaatttttaaattttttatagagaagaggtcctaagaaagtacctggagcaggctgcaggatgcagttggaactacacaaacatggagtttcctcttcctccttccactgttgcccaccccaggtccttggcaatcactcctggagcctcctcttggaagccctccaggcctcaggtgcttgctctagctcctgagatgagctgtttggaatcatcagactctgagacaccccccagatgttgccctcaggagctgaagaagatccaggcaagctcctgccctcactgagccactcggtctccgcacacacactccttccgtgcttttgctgagagcagcagctcagcaataacttaggaaggccgagctgcccaagggagttaacactcagccagtgatgtcctcacccccacctgctaatgcctgttcacgctgaccactttttacctgggcacagtgccagttccatcacatacctgaactatctcatttaatcctcataacaactctctgatgtaggaactgttactgtcccagacagataatgaaactggggcccaggaaagtaactctcaaggtcacatatctaataaggagcagaaccagcatttgagcccatgaggcttggctctggagtcgaggcctgcacccctaaaccttgggatctctgtgtctccacacccagaggcttcaggcaagaggagtcagggacccacagtggctatgttcttccttttgtttatttatttttttctgagatagggtgttgcccaggctggagtgcagtggtgggatcatagctcactgcggcctcgaattcctcatctcaagcgatcatcctgcctcagcctcccaagtagctggggccacaggtggaagtcaccatgcccagcccattatattatttctaatcctcacggtgagcctgcatgatgggtataattttcccatttttgcagatcagaaataccaaggtctcaagatattaagtaaaactgttacatgaccatgtttataagaggcaaattcagattcatctgatcctgaagcctgagacttccattttccactgcccagtcggaatgcctggctcctagaggttggcatcaggcacacctaggagggtggcacagccaccgtcatgacagttttgagaggtgatgaacccccatctgtccaagcactcctccatgactcccatggtaccaaccaaattccagcctgagagttactgttcaaggaccttcttcaagagccctgcaaagtatccgtggtaatgagttatgttatctgtcacgggaacacatgagctaacagacagattagctgcctttatctgggcttaactgtctgttgcaaagaacagagcccaaatggattatgacagaggatggggacactttgactggggggtgaggagtggatgttcaggaagctgtcagggtaatggggtgagggaagcctgaaggatggatgtgggagagcccagagagagggcagctgaatgtgcatgctacgctttcctgtgcagacccaggtttgcatgcctcgagctccgttactcatgctgcagagctgttactgccctgttctagctgcagcacttaggactgttgcccatgcaggacacttatgatgccctgctcgtcaagaaggcaagcactgggagcagggaacatgagtggaaatatacgtgaagtgtttaccatgcagtgactgcaaaacagctggcactcaataaacaagagctgctattagcattgtattaagataattatgtgttatcaattgatcaattgattgattgatcagcatcactcatttatcttctctgtactctccatggtactcagtgcaatttggtacctccctacccctccaggtaggaggtgggactcaaccctggaggcagggctcggacactgaaccaaattgaggactagctaaaacagggatggggtggaagcacctttccataagacacgcccaccagtgtcccatgtcagtttatcgttgccatggcaacacctggatattactgcccctttccatgacaacaatctggcatcccggaagttccaaccccttctagaaatgttggcataattcgccctttaatttgcatgtaataaaaagtgagtataaatctgactgcagcactgccctgagctgctactctcagcacatgcctgtggggcagccccactctgcaggagcaggcacagagctgcaacactgccgcctccataaagccattttcttctaccaccagctcacccttgaaattttccctgggcaaagccaggcaccctctcaggctaagccccagtttgggctcacatgccctgcatcactctaactctctccttcactaaggcagcaaccactgagtcacagtgaacactgcagactccagcctgacggcatacacagagcaaagcctcctgggctgaaccttcctgccctggaatctgagaccctacccttacgagggagatccctggagggtaaacagagatgtcagcccttggggacctgcagcaggagaaccacctctggcccatgaaggacagttgatcctccagggttgcagatgactagagagtcctgagctggccagcacaggtggctgcatcctcgctcctgtgctccctgagtatgtgtgtgtggtggggggtacttctggaagtgctgacctcagatactcacttatgcctctagtgtttctgcctgacccgctcctatgctcctatcagacctggaaacctggtgactgcccacaccctacagacagtcttatctgcaactgggaatcaataggtatttattgttgatttaatgcccagagattgtaagagagcatatggctcccaggaaagtgtgtacatgatatacaggatctgcagctggtctctgcagaagtacttttgggctttaactaaggtgcatcatggtgcaagggagatttttggttggaaagacattagagtctcacttctcatagcctctcaaggacaatgaggagtactgtgtcagtcagctactgctgtaaaacaactccaaaacttaatggctttactcacatgtccatgagtggaaggttattggctggaatgacagaggcccctcatcaccagaagcagcccaggctgctgcacgtggtggcagtcacagtgttcccaaagcagtaatagcagacaggccccacagcacaggtgcttgtcagcctctgcctgtttcacaggagcctaagcaagtctcctgacagagccccatctcaaagtgcgagagcagtcaacgtcacagcaagaggatgtgaagccgaggagggacaaattgtagccacctttgaggtctatcccaaggttgaatgaacctgcaggtaggctgacatttactcttgcactcctcttaccagaacatcaagaccagctcttctccactgtgcctgacttatcaaaatagatctcaatagatatttgaatggctgcataaatgaataaatacacaatgcatgaaagacaggaaggaatgaattaacaagaggccagtaagagagtgagtgaatactgtcctaacactcagggtgtctttttttaggtcctcaggcctgggggaagattccggaatttggagaagaaacgtagaaacacacaactctttaagatatagaagcattaaagaaaatgtctggggagaacagactatgggcacaatgagaaaaaactgaactaagaatcaaaagccctggccgggtgtggtggctcacacctgtaattccagcactttgggaggctgaggtgggcggatcacttgaggtcaggagttcgagaccagcctggccaacatggaaaaatcccatctctactaaaaatacaaaaactagctgggcgtggtggtgcatgcctgtggtcccagctacttgggaggctaaggcaggagaatcgcttgaacccaggaggcagaggttgcaatgagccaaggtcatgccactgcactccagcctgggtgacagagcaaaactccatctcaaaataaataaataaagaatcaaaagccctaagtcctcaaactttgttctttctctaatcctaacatgattcattaattttctcatttttctgtttcaataagtatttattgagtatctactccatgcccggcactggcccctaaacccatgacattaccagttagaagctgttctaaatgaatgagtcccagacctcttttgaggcatgcttcccacctgcactgggaggaggagaggcccactcgcattgccactgctgcaccccctccctaaaccccgagggcctctcaggctaggggctgggagcaatgggagactggggccagagctggttttctggattgacaggatagggcgtcccagaccaatgggaactctcagatcccttttagctctaatgttctaggataagaactggaaccatgacaagcccctgagtgatgccttccatcacaatcagtaatcctgcgctgtggggaaagcagacatccactgatggcccacacagggaagcccctaagaacaacagaacagcaagacaggatcctcaaaacatcccccaaaccaagctccatgaccacacacaaacccaacttccctgatctgttatcctgccagcctctcatgacaaagtccagcttcctgagtaaattcgaacaactcagtcacctaactcagaactccatacttcagggagcaaatggctgatgcagcccccagtggagccactgggccctcattgcagaataaaaacacatccaaaacatcaggcacctcctgagatctcggcgtgccccttgcagcccactgacttcatcaggatgaggacaggcgctctctcaacttccctctctccctcctaaatttttctgggcacctgctcacccttacctccttccttccgcccacaggcttggatatggccttttattacacttcatccaagtgggttgtcttcttaccctatcttcagtctgtctccctgctggcttacaaacattccagcaccctcccttgtccccatttgtcaatagcatgagatgctgttgattctccttcctcatactctctcccaagcaggcactttttcctaacttccctgctcttccctgactcccagccatgcaggctcagactctgaggttcatctttaatagcatcacgtgccatgataaaagcctcaagcattgttgcttgaggattccttcgtctctcttccccatccccccacacaatcaggtgccagcttcttcttcttctttttttttttttttaaagagattgggtctcactctgttgcccaggctggagtgcaatggccatacctgcatcatcactgcagccttgacctcctgggaccaagcgatcctcctacctcatcctcccaagtacctgggccacaggcatgtgccaccatacatggctatttttatttttagagatggggtctcaggtctcactatgttgcccaggttgacctcaaactcctgggttcaagcaatcctcctgcctcagcctcccaaagtgctgggattacaggtgtgagccactctgccggccccatatgccagcttctatctatcatcttccatggtagcttgtgaaccattccttctcttcatacccatgaacacctttcctttcaccttctcaggactacagtcagagtctttgggccctcgtttctccaccatttcctctccctttttaaataaatagcctatttggggccaaggcttgtacatccttatatttgatcctcctaccctccctttggcctggaaggattcacctctgccctgccacggccgacccagcctccaaggttccctcccctcagtgcagcccctctaggaatcctctcatctcctaccttgccccctcccaacaaccctctcccgggagctggatgtcatctcactgtcctctgcattcctacagctctgtctctgtactgtcctaagctgtgtatccctttctacatcgtgtgctaggaatctgtgtgttttcctttctccctgctgataaagattccttgagagatgtaactacatcctttatattattacaccttccacagaactaggatgaagcctttggatggatttgttgaatgaatgaatgaaagaatgaatgaatgcatgcatgagtgagtgagtgaatgaatgaagcccccagctttcacagaaggcagtcacagagtatgtgtagctctctgggcaggcaccttgggacgcttgcccagaagcaattttgtgtaaaagtatcacgcgaattatttaccagagctatgtctcttgacagcaatctacagacacctctttgtagaagcaatgaaattaaaatctgttgcattaaacctaactccttaagcagccccatcttcaccccatcccccagcccccctccagatacatgaggatggagcacagcagcttctcccctattctcagcttctcccttattcctacctgaaactgagtggtctcccccaaccttggccaccccgcccctgcccaggctcagccattgagtttacatcttttagcctaattcattttctagatagatggagcaaatacctagcaaatattatttatggctttgtgataaataagccttttacagaagtttttcaaggagttctggggaatttcaaggataactttcagcaagtttcaaaggtcgggtcaggctgggatactgagcccatagtatttgccgggccgttcatctgttttgaattattggccttatcaagcttccgcgggctctcaatggaggagctgtgctgtagctctcaggctgtattttatttccatcgtgggcaacggtctttaatgattatttgtgctagactgacagtggggagaaagaaaaaaggggtcttcatgaaattcaggctcccgcagatgtgctgggaaagatgttcctacctgcctggccacccctgcccgtgtgcccccaaccccgcacacagggtgatggcatccccccgcgtgcagccaagaggacttggcggcacagagtggaggtcagaaagggcagagttttcccaagggtccgggaagcatgggcccttttctgatgtatgaacaaacacacatctgattctgtgcagacttgcaaatgtagcttcttgggagcagagaccgcgttttgttcaactccacagcctcggaacctaacactctgtctgcacatagtaggtgctcaataaatgttggttggattgggttggattggattggtttgaatcaagttgaatcggtctcctactccctcccttctaactgtggtttccttccacagaggctttgtgggttttttaaaaaaatttcttctctttccttttgcatttattgttgttgggtttttgttgttggtttttttctctcattagtttattttggttgtttggatttgattttgacttactctcagaacggatttgcttgaggcagaagtttggcctagaatgcaaagttctttccagatctagacatttctcccaagatgatttggcaaaattttccattcctgagacctaagactatccgcctgttactctagaagtgatgtgaaacaaagaatgaaagatgctctctcattgtacattcttttatattggtatcgctctcttacagctttgaaaatggattttccatagccttttctactaatctgatacctttactggcagttccaccaggcacacatgggttcttaaaaaagacttggtgaagtgaattgaatgcagaaagtctggatttgttcacctctttcgctgtttgtttttaacttcagaaggtagaaaaatgtctcctcctgtgagaaatcaatcaagggctctctttgtctttagactaaggcacgttctgctagattcccgtcttataaacatctgtccctctcactttatgtgataaatatggcctgaagaagtgctacctttgctatttttaaaaaatcaaattatatttaaatgcacttgtggacatttaaagaaacatcttctaaacatgaataactcactaatttacctacctgtccaatctgagtctttcacattgggtttgctcaaggaaactttctctcttctttgttcttctttcagaaaagacaattgccagtggaatctccttcctcagacatagaagccaggactgaggccccaggagggcaggcctgttagccagaattgtatctgggcccaaatagaaggctgactccaaaaaaagaggtttagtaaatgagaaaaagctgagatcactagtacccaaagaggtcattaaatcatgagggaggacccaggccggaggatgtgatgggatggagtggcaggaaaagaaaatagaaaataataagcccattgggccagaaaaattaaaaccccatgacaaaggcctttgatgttgttggatttcacttgctcttgcatccagctctctgccaggccaggtactaaagcccaaggacagagtcagccgggttcccggcttgtcttcctggtgaccttgggtttctaccagcccttccagcttctggatgtgaaccttccagcagagtcctctgttcataaagacatcctcagcctccactgtcctaaccttcaaatctgttaatactcaactccacaaatgatggagggatgacgggtgcctgccatggtgaatacttcagatctatttcataaggaaaagcatcctttagtaaaaagaagagaaaaatgaagctttttccctagtacttcaaagcacgtggggcccagtggcacttcctgcaccagggctttctgcaccatcttctcctgggtctttgctttgtctgctctgagtggattgtgtgccaatttctccttcctctcctggagaaccccttttcttttcagcaccatcccaaggacgggataaagtcctggtggtttgctctagttaactattgctgtgtatcaaaccactccaaaacttaagtcgtttaagacaacaatatactatggttcatgtatatgttgactaagtcagccaggcagttctcgtttagggtctctcatgggctatattcagataaatggagcccggatatggatcacctagagtctgaatgtgactggacctccaagatgaatcatgcacatggctgatggttgacattgactgtcagcagctcagctgtgctgttatccaaagcacctccatgtggcttcaccagatggcctggacttcccacatgatcgtggccaagtcccaagagggggtggctcatgcctgtaatcccagcactttgggaggccaaggcaggctgatcacctgaggtcaggagttcgagactagcctggccaacatggtgaaaccccatctctactaaaaaataaataaataaataaacaaaaaatacaaaaattaaccaggaatggtggcaggcacctgtaatcccagctactcaggaggctgaggcaggagaattgctcaagcccgggagggggaggttgtggtgagccaagatcacgccactgcactccagcctcagtgacaagagcaagactgtctcaaaaaaaaaaaaaaaaaaaaaaaaaaaaacagaaaatctatggaactcagctgtgtcacatactcagaaatgtcccggtgctccccccgtgtgctttatttatttttattttttttaagataacagaattggaaaccaaacatcaaactgcttcctggggggtcttctctggacttataattaagaataaaaggtaaccaaaagaaaggagaaaaaggcatggagggaaaagtgaaaacgcaacttaaaaaaaaaaaatgaacattgagagtttgaataattccaaaaccctttctgtttaaaagcaaagtaaatcttccagagcatcaaagccctgtagagagcaaatggggtttatagtgaagatcctaaatccccaatctgaagactgcccctcccccactggtgctaagagcagaggcaccaagccattcactcgtcccctgcaggagtaagtaggttttcctccagcctgtcgcgggctccttcctgaaccatccgggaatgtctctgctctgagggtctctctctcccctaaagaatccctgtccacctctgtagggggcatctgggaaatgggtggaggacacagcggggcggcgactggccccttccttgctgtgtggcacagggaaatctgcccccaccctgtgcccaggcccgatcacgcatgaggctaaagacggtgtgtgtgaagctgcttccagtttcttgtaggattatacagctgtaaagagggccaggaagagagagggggatattgtgatttgcattttgcactcctgatcttaaaaaatttgtatcccagcaggtttgggaaaaagagccctggatggagagtttcacaagctggggtctgacctatttcaccacccactaactgtgggtcttccattttcccacctcaccaggccacgcggagaagcagctctgctcccctccctctgaggggtagggggacaccctcacccctcaaccctttgaagccactcatttgtccccggctgcctcctttcaggccactgtggggagctgataagaagaagagtttgcaaacgggctaccatggagaaaattcacaagttgttttcctaaaaagggaggaattggagtgggggcgggcatggtgggggcagggcccgttccctcggctctggaggtctctatattctttagctcttaatcattagatcggaaaagggggggaagggcaggcaatggaggcagaggaggagggaaaggggaagaaaaaaactcaacaacaacaaagagccagcctaacactcaggtcctcggggacccagaactccattcagagttttcagaaaatagggtcaggcatgtcttgtgacctgagaccccagagctcctctgttccccataattatctaatacagcactctctctgccaaatacaatgaaacaatttgtcacttcaattatctgtcagtcaacactgaggccttttcagcaggccagcacatgtgtttggagagcttgtcagtgagggctgtctagccagacccataaccacggaaaatggaacctttgttaattctggttcttagaaaagtaaatccattcaatttctctcctctcgctctctccttttctaaatgccttcagcttggaattcgcacaaggaactgaattggtcctgctctgaacttcggatgactggccgaaggatttgcatgaggaagcagaaattaattattcttttcggggctttttccccctcgttttctgtaattctgtgttagaagcgagattacaccctgcgttaccagcggatgggggtggtgagggatagggaagtgggggccgggctgggagaggcaagcggttcctgagttcagccccgccagcggccctgctttccttttccttccctgctctcatgtgggaagaaggcagctccatgcccgccgccaaggggaaggcgggacatgtggctccctccggaagggcgctccccttcagggtcctggggattctccacttggagaaataaaggaaaaggaaatgggtcatcccttgggcagagcctgacttccactcctagacacagacctaaggctatttcctgccaggacgcagaggcctcctcccctgtgggtggacagggacctccacgctgtcagggacctcctccccgtgagggcaaagcaggtccatggctgaatcattgaggcctgcctgggaagtctgtacatcagtgatatttcccagaatggtctaactttaaatactccagcccaccgtcagaccatgtgcgaagctgcatgtctccatttggggttgagaatttgaagctgctctaagaccgggtgccagcacccaagccagaggacccctcccggctcacaggggtcctcgcacagagagatgctggtgtgctttgaaggtgggagctgggggtaggcagtggtttggtatttcatagctcaattgtttccacagtaattgggttttttttagagacagggtcttgctctgtcccccaggctggagtgcattggcaccatcgcagctcactacagcctcaaactcctgggctgaatcctcccacctcagcctgccaagtagctgggacaacagatgtgcaccaccacacccagctcaattttttttaatttttaatgtatttatgtattcatttattttgtagagacagggtctccacaaacgttatgttcgtaacatgttgcccagactggtcttgaactcctggcctcaagcaatcctcccacctcagcctcccacagtgctggcattacaggtgtgagccactacacccagacgccatactgattttcttcatacattgacctataacaaataaaattataatgttttaaaatttacatccatgacttcatatatgctaaatgctttatcccactttagacttttacagatcctctctatgagggcctgtttcctccccatccaacacaagcccaaagccgggatccagtacttcctgcttctgggagggtttcctttccctccttccagtcccaggacccagaaccaccaaagaacacacattggtgttttccaaggtattagaatcgtgtccccaggacatctgagaaaacaggtccctgaaaaagttcaaatcaaaatctctctcgcccacagatgcactggagagtgtccatcctacagcctggcctctgtgtcaccagaatcattcttgcctctgccctttctgtctgctttctcccctgcctcactttcttcctctcttcttctcctttctttccctctttttccatctgcttcctttcctgccttttccctgccagacttttctctatattgtttcctcatttatccttccttaggattttggcctcttcctgtctttttcctttttgagtccaaagaatttcacagccatccctgtagtgttggattgtacaaagagagaaaccaccctcttttttcctttttttttttttttttttttttttttgagacagagtttccctcttgtcacccaggctggagtgcaatggcacaatcttggttcactgcaacctccacctcctgggttcaagcgattctcctgcctcaccctcccaagtagctgggattacaggtgtgtgccaccacatctggctaatttttgtattattagtagagacggggtttcaccatgttggccaggctggtctcaaactcctaacctcaggttatctgcccgcttcagcctcccaaagtgctgggattacaggcatgagccaccatgcccagtctcttttttcctattttataggtaagagaatataagccggagtgtggactcttaaattcagtcattgctcaataaagaaagaaatctgcaaccaccaggtaggcccagtcccagccaggcctgtaatgggtgttcctgcctccatctcacccccagaacagagcgcacttttccccacgtgacttaggtggcagaagtcctctaacacgccatcctggcagccaacatgaacgtggtccaagagggaactgggtctttttctcctgagctgtgagtggagcctcttttcagctctcaaggaagagtccatcttgggggatgtggcaatgggggaagaaaatcacctttctttctaaatgatctcaaagttaacctggccctacaaaatgagcactcactttgagaagccacacacttatttgaaatgtttttggaaattaaaacatatagaagagcagcacaaaaaacatcagacacattactttctaagaaccccatgttttcaagagggggttcacatttcgtgagctccagcatcattctctgccttttttcagattttattctgattgacttggggatttttccaaaaatcaagcctacccttagtgtaggaaaatcagtatagaaaaaatatatatatatagcatgcccttagtttaggaaacatagcaaccattagggcagcatgaaaagcgacactgcaatactgaaaacaattccaaaggcagaatgtgcccagcggagccaacgtctaggcaggagcaggataactgaagcatcttctgggaaggtagctgtagcattgacacagaggccaaacatcacagctgagagaagcaaaagacctgatcgaaattaatacacgaatatcagggctaaagctggggaggggggtcagtctgttttctctcatctctgggacaggcacactatggctctcaccccaccaacctttccccaacctccatgctgacctactccccctcccctgcaaattcccttcatttagttgacatcagtttttaacctttcacctccagcgacatctactgtttgctctttgggaaacagagtgacatggttgccccgtctcctggtcactccccagagaaaaggggcagaaagagaactggcctgaatgagcaacacaggccgggagctgtgtctaatcccatctccagccctgcacaatttagaagcctttcccaaggagcccttgagaccacagctgattcttcctgtctcacaaacgctgcctttccagcagacgttttgattttctcatcctacccttagatagtcgactttcctccacacagccgatctccctgtaagcctaggaaagaagaaaatataggccaggtgtgggggctcacgcctgtaattccagcactttgggaggccaaggtgggtggatcacaaggtcaagagtttgagaccagcctggccaacatagtgaaaccccatctctattaaaaatacaaaaaattagctgggtgtggtggtgggtgcttgtaatcccagctactcaggaggctgaggcaggagaatcgcttgaacccgggaggcagaggttacagtgagctgagattgcgccactgcataccagcctgggtgacagtgcaagactccatctttaaaaaaaaaaaaaaaagaaagaaagaaaagaaaatatatttggggagagtggtaacaacctaatgtggtgaattcaaggaacacagccagactgtcaagaaaatccttccaggaaaagaagagggggacccagaggaagaaaggtcaagctctgagcaagtgttccatggctcctctggtcatcctgtgtctgagacacccagagacttggggaccagcctgaaatccctttgtgctacattcatttgagtaatcgaggttttaattctttccttagactccactccacttagctttctctggctttaatcacaaaatgtccaaaaattggaatgtgtgccatttctcttgggtgactccacagagtaaatattttttatacaatttatccagaaacccagagatgttggctgaaaccagtccaaatgcaattttgccaccaccctcctgagaaacagtgaataaagctccttgggttgtgaagcaaaattacttgacaggcaacaatgcgaaatttttaaatacgtgcttcatcgaactcaggcagtataaactatttcaaactatttttacatctagggtagtaagcacggtaaaagaaaaaattatccagcgacacttattaaagcacagtgagacactttattcaggaccaccaccgtaggtacacagaccactgcagtgaggtcttgcagtgggggagggagatggggttcaactcccgatagatcatgggcgagtggcaattgctagccaacgagcagtgtgggcttcaggagatgaaaagttactaagaggaaactcagaggtgagagggacaatggtacactgacctaacaggatttttgctgaagacaggctggggtgatcaggcatcacctggggatggtggaggatgagagatctgatcatatattgagggtgggggtttgggctaaactaacttggcagggctcttctgccaacgctggattttataaggaagtgcacttataggcctaggaggagtttcagaagatggactaaagtttggccaagcaaaagaaactttgtcagtccccactcttgttcaaggaaaaaagaaacattcttcttttcattgaataatattaaagcagcctcattgtctggaataacagctgaggttcgttgtctcacagccacagagaacaaggacgcagacacacaaagtgtaaggttgagagtggaagtttaataggcgaaagaaagagatagctctctgctatagagtggggtcccagaaaaatgggttgctggatctgcagtgaaatgcagccacggtgggagtgtggtggggggtgttatggtgtctgatttacatagggcgtgaaaaactggttggacccagtgttccatttgcatagagtgtgaatctctggctgcccccatcccaatcttttattatgcaggcaggttctctgcctgagcttccccatgttgcccatttctttattactgtacacctggtaataaaaaaaagggaagatggagcctccatggtggacatgcctggcccccaggtatcccttttctattggcacagctgctggcattcctccgagcaagcttccagcttgcttatctatgtctgcagctcaatttttcaggctgctcttttttagaaaagaaatgcttttggggaatgctttttgctagagggaagaagctctgtcaggagtcttttgccctcactatctgcctaaataacttctttctacctcctctatcaatataaggctattttccttcttggttgccttttgctcacgaaggaccagctggctcatttcttgggatctggtagtgaggaagatctcctggatggtgtgagcctttaatcaggggagcttaatttccatgaaaataaaagaaaaacaaagattactacctggaacaaactataaactcaggtttatacaaactcagagagcagccaatcaagaaaatttctagatgctgggcttcaagcatctgcagttggagtaaggcagaggcaggaagtggcaaatgacagattttcctggtttacagttttgagtgtcacaaaggttgtccgtacatacacagttgtggtgatctctttcaagtttatatcaagacctcaagcttcagcttgcaggactacaaaaaagagcagttttaccttcagtgatttcaagtcagaagggtgggagaaaatcagaaatattaatttggagaattgtagctagacattggaggaaactagaatttaggatgcagtccagattacaggcagataataaaacttcagagaaaataaagagggctagactctaatgttgggtacactatagttttcttctgaaagataatttttcttttaacagtcacccccatttctaacaagatgatcaaaataagactgatttgtttgcaaaataactttggtctcattaaacttgattatttacataactgcatcactattcttacatatatacataagtgtaagaattatgattgactatatcggcttctgttaattttgatggaacttttgatgaggaatctcagattggacttgtaaaagcctctcaaagacaggaagccacacaaaggacttgccataaagctatgtctgtaacacctatagttttgaatgaattcctttcttctcaagatccccaaaatatcctgtttcttatgccagccaggaagtgacattcctgactcacctgtaaggccaggaactctcaggccagtttttcaaaaagagagctttattgactccataaagtcaggcttagtttcttaaagctctttggtcatagctgaaatatgacattccagtgaaagccttggtaatataaccagtgtttccaattgtgtcctgttacaaaaagaacagattcttattgaaatgaagcaaattactacattgccataaaaataagaatactcacaaatagtttcctaattctagaaggattgggtatggagaaaaaataaatctttcaacttttgttcacaaaagtatactttaccaaattgctgtaagctatcaatagcttttaaaagcttccttaaatctgaaaaacaaaacttttgaagaatcaacaatatttccaatgaaaagtcacttaaaaattatcctcatcagttcattcaatcccatgtaattaattcttgttctgcttgatcttgggacagcagtttcatgaacccattggtttcattagatttctggaaattcttatccagttcaatggtatgatcttaaagttatcagaaacctatatttgtcagagtttcttttataaatctccttgaagatacagcattttaggattgtagttgcttacaaagaaaaaaattttcagaataaagcacttaactgtggacaacaagacttcaaatggctatgattaaagttctgatgtgagttcagtgtaataatggcacaactcacaatgaatttgtgagtttctagtatttcctagaaatactacatttctaggaatctcatgcaatttttggaacactcatatcaataacacatccataaatataacttaaagaacatttagcatcacttattatttgacaatgcttcccatataatttaacatatcaaataagcctaattagtttaatagctctattttccaaagtgaaagatacatccttcaaggctttcctgaggcccaattaagtcaaaaagacttaatttagaacttgatttgggtttgtccagaatatcaaaggtttaaaacacttgattaggccaggcatggtggctcacacctgtaatcccagcacttcaggaagccaaggcaggtggatcacctgaggtcaggagttccagaccagcctggccaacatggtgaaaccccatctctactaaaaatacaaaaattatccaggcatggtggtgggtgcctataatcccagctactggggaggctgaggcaggagaatcgcttgaaccaggaaggtggaggttgcagtgagccgagatggcaccactgcactcaaggctgggcaatagaccgagactcagtctcaaaaaatatataaataaataaataaaacacttgattaaatattagttatctatttaattgaactgataatgaaagattttaaatgtaaatacagaaggtgacgtacttacgaacaaaaatttagctcttttaatattgagaagacccaattttcttaagtaatcaaagaaccaataaaatacaacattaagcacaagaaattatcttgataaaacacataatctttgtttcctaggccagttacataaaaggtaaggaaaacccttcacattctcagaccaatatgccaaaaaaaactttgtcattttaatagagaagaccaaagtttgttttgcatcagtacactactaaaacaaatttttaatgaaaccttataaatgaatatatctggcagttttgactacacaagattttcatagctctttaacaacctctttttttttaacttttgcaactaacatgcatcaggcaactcatttgtactgtgtattgtgtttaatgtgtctatgattttaaacatctaagcagagacaacacaaacctgtctgaccagcataagcatgcaagaatgtctgtattatatttaatgctgacaattctaaagacattcttattttaactaattatttaattaatttttttagagatgggagtttctctagtaggtccaggctggagtgcagtggctattcacaggcatgaccatggctcactacagccttgaacttctgggctcaagcaatcctcctgccttagcttcccaagtaactggaccactgtaccaggtttcctacttttattttaccaataatttttaaactaacttttatttaccaaagattatctcagatcatattaactttaaaacttgggggcactttccatttttctgagacttttatgaatatttaatttatctgagcatcatttatacctaaatcaacttggcattttagttggtaattagctggcatttagttggtggtagaaaaataccatgtatacataacatagaaactaaatacatatacatgtacacaaacataaacatacagacagatgcaaccaaatcctattgtttttcatttaaaaattcttatcatgaagcaataaaacagagtaataaaaactcactggtttatcgccacttatactttttttttattatactttaagttctagggtacatgtgcacaacgtgcaggtttgttacatatgtatacatgtgccatgttggtgtgttgctcccgttaactcatcatttacattaggtatatctcctaatgctatccctcctccttcccccaaccctatgacaggccctggtgtgtgacattccccaccctgtgtccaagtgctctaattgttcaattcccacctatgagtgagaacatgcagtgtttggttttctgtccttgtgacagtttgctgagaataatggtttccagcttcatccatgtccctacaaaggacatgaactcatccttttttatggctgcatagtattccatggtgtatatatgccacatttgcttaatccagtctatcgttgatggacatttgggttggttccaagtctttgctattgtgaatagtgccataataaacatacgtgtgcacatgtctttatagtagcatgatttataatcctttgggtatatgcccagtaatgggatggctgggtcaaatggtatttctagctctagatccttgaggagtcaccacactgtcttccacaatggttgaactggtttacagtcccaccaacagtgtaaaagtgtacctatttctccacatcctctccagcacctgttgtttcctgactttttaatgattgccattctaactggtgtgagatggtatctcattgtggttttgatttgcatttctctgatggccagtgatgatgagcatttttttctgtgtctgttggctgcataaatgtcttcttttgagaagtgtctgttcatatccttcacccactttttgatggggttgtttgatttttttcttgtaaatttgtttaagttctttgtagattctggatattagccctttgtcagatgggtagattttgaaaattttctcccattctgtaggttgcctgttcactctgatggtagtttcttttgctgtgcagaagctctttagtttaattagaccccatttgtcaattttggcttttgtcaccattgcttttgctgttttagtcatgaagtccttgcccatgcctatgtcctgaatggtactgcctaggttttcttctagggtttttatggttttaggtctaacatttaagtctttaatccatcttgaattaatttttgtacaagatgtaaggaagggatccagtttcagctttttacatacggctagccagttttcccagcaacattgattaaatagggaatcctttcctcatttcttgtttttgtcaggtttgtcaaagatcagatggttgtagaagtgtgctattatttccaggggctctattctgttccattggtctatatctctgttttggtaccagtaccatgctgttttggttactgtagccttgtagtatagtttgaagtcaggtagcgtgatgcctccagctttgttatttttgcttaggattgtcttggcaatgtgggctcttttttggttccatatgaactttaaagtagttttttccaattctgtgaagaaagtcattggtagcttgatggggatggcactgaatctattaattaccttgggcagtatggccattttcacaatattgattctttctattcatgagcatggaatgttcctccatttgtgtcctcttttatttcgttgagcagtggtttgtagttctccttgaagaggtccttcacatcccttgtaagtcggattcctaggtattttattctctttgaattagttgtgaatgggagttcactcatgatttggctgtctgtgtgttattggggtataggaatgcttgtgatttttgcacattgattttgtatcctgagactttgctaaagttgctcatcagcttaaggagattttgggctgagatgatggggttttctaaatatataatcatgttatctgcaaacagggacaatttgacttcctcttttcctaattgaataccctttatttctttctcctgcctgattgccctggccagaatttccaacactatgttgaataggagtggtgagagagggcatccctgtcttgtgccagttttcaaagggaaagctttcagtttttgcccattcagtatgatattggctgtgggtctgtcataaatcgctcttattattttgagatactttccatcaatacctagtttattgagagtttttagcatgaagggctgttgaattttgttgaaggccttttctgcatctattgagataaccatgtggtttttgtctttggttctgtttatatgatggattatgtttactgatttgcctatgttgaaccagccttgcatcccagggatgaagccaacttgatcatggtggataagctttttgatgtgctgctggattcggtttgcaagtattttattaaggatttttgcattgatgttcatcagggatattggtctaaaattctatttttttgttgtgtctctgccaggcttcggtatcaggatgatgctggcctcataaaatgagttagggaggattccctctttttctattgattggaatagtttcagaaggaatggtaccaggtcctctctgtacctctggtagaattcggctgtgaatccatctggtcctggactttttttggttggtaggctattaattattgccttaatttcataacctattattggtctatccagtgattcaacttcttcctggtttagttttgggagggtgtacgtgtccaggaatttatccatttcttcttgattttctagtttatttacatacaggtgtttatagtattctctgatgatagtttatatttctgtgggatctgtggtgatatcccctttatcattttctattgtgtctatttaattcttctctctttttttctttattagtcttgctagcagtctatcaattttgttgatctcttcaaaaaaccagctcctggattcattgattttttgaagggttttttgtgtctctatctctttcagttctgctctgatcttagttatttcttgccttctgctagcttttgaatgtgtttgctctttcttctctagttcttttaattgtgatgttagggtgtcaattttagctctttcctgctttctcttgtgggcatttagtgctataaatttccctctacacactgctttaaatgtgccgcagagattctggtatgttgtgtctttgttctcattggtttcaaagaacatctttatttctgccttcatttcattatgtatccaatagtcatacaggagcaggttgttcagtttccatgtagttgagcagttttgagtgagtttcttaatcctgagttctagtttgattgcactgtgttctgagagacagtttgttataatttctgttcttttacatttgctgaggggtgctttacttctaattatgtcgtcaattttggaatagatgtggtgtggtgctgaaaagaatgtatattctgttgatttggggtggagagttctgtagatgtctattaggtccacttgctgcagagctgagtttaattcctggatacacttgttaactgtctgtctcgttgatctgtctaatgctgacagtggggtattaaaatttcccattattattgtgtgggagtctaagtctctttgtaggtctctaaggacttgctttatgaatctgggtgctcctgtattgggtacatatatatttaggatagttagctcttcttgttgaattgatccctttaccattatgtaatggccttgtctcttttgatcgttgttggtttaaagtctgttttatcagagactaggattgcaacccctgcttttttttgttttccatttgcttggtagatcttcctccatccctttattttgagcctatgtgcgtctctgcaggtcagatgtgtctcctgaatacagcacactgatgggtcttgactctttttccaatttggcagtctgtgtcttttaattggagcatttagcccatttacaattaaggttaatattgttatgtgtgaatttgatcctgtcattatgatattagctggttattttgctcgttagttgatacagtttcttcctagcattgatggtctctacaatttggcatgtttttgcagtggttggtaccaattgttcctttccatttttagtgcttccttcaggagctcttgtaaggcaggcctggtggttacaaaatctctcagcatttgtttgtctataaatcattttatttctccttcacttatgaagcttagtttggctggatgtgaaattctgggttgaaaattcttttctttaagaatgttgaatattggcccccactctcttctggcttgtagagtttctgccgagagatctgctattagtctgatgggcttccctttgtgggtaacccgacctttctctctggctgcccttgacattttttccttcatttcaactttggtgaatctgacaattatgtgttttggagttgctcttctcgaggagtatctttatggtgttctctgtatttcctgaatttgaatgttggcctgcctcgctagtttgtggaagttctcctggataatatcctgcggagtgttttccaacttggttccattcttcccgtcactttcaggtacaccaatgagatgtagatttggtcttttcacatagtcccatatttcttggaggctttgttcatttctttatactcttttttctctaaacttctcttctcacttcatttcattcatttgatcttcaatcactgatactctttcttccacttgatcaaatcagctactgaagctcgtacatgcatcatgtagttctcgtgccatggttttcagctccatcaggtcatttaaggacttctctacactgtttattctagttagccattcgtctaatcttttttcaaggtttttagcttctttgcaatgggttcgaacatcctcctttagcttggagaagtttgttattacctattgtctgaagcctttttctctcaactcatcaaagtcattctccatccagctttgttccattgctggtgaggagctgtgttcctttggaggagaagaggcgctctgaattttagaatgttcagcttttctgctctggtttctccccatctttgtggttttatccacctttggtctttgatgatggtgacgtacagatggggttttggtgtggatgtcctttctgtttgttagttttccttctctcagctgcaggtctgttggaatttgctggaggtccactccagacactgtttgcctgggcatcaccagcagaggctgcagaacggcaaatattgtagaacagcaaatgttgctgtctgatccttcttcagga

SEQ ID NO: 40 - DNA, 172568 bp, Artificial Sequence
  Synthetic BAC sequence
gcttggtggtgttggttttgaagtaaaaatcaatgtatctctgcatggatagggcaattgagtaagctatatcagattggacaggtacattagctgtacagtggtgcatatattcagctgtgaaaagacaagcaaaagagaaacaggtgaaccacagcatagagcaccaattcattttacagtgatttttttctttttatacttttaattacttcgccttcttaacattgaactttcagctgtgcaaagaaagggaggattggaagacagtaattgcccaagtgtgggtgtttgcttgatgcctatgggcagaggggccagagaggggatagtcaatgtgggggatgcaaaaggtgttgaaaatggaaagactgagtggagcaaatttctctgggaaatttgtcctcagtgaagctatagaagactgaatatttgaagaatagttcaaagaggtgtctaggaaatgcagatctggcttcaactccccttccactttcttctactccaaaacaaacatctatgaagccctgcaataaggtaggtgcttgcagcctttaggggggccactcagtcaccccaagtctcagttgtttccactggtagcgtgataataatcattttcacttttagagtggttaaaggatggatattgtgtgtttaaaacacctgaatctccttgtataatacatagcgggcacttaatttacatttgttgaaaggatctgagcctttgctttcatttttcttttcttttttttttttctgaggtagggtcttgctctgttgcccagactggagtacagtggcatgatcactgcatgctgcttactgcagccttgacctctggggctcaagccatcctcccacctcagtttatcaatcagatgtcattttcctcattaacaatgccattccacctttatcggggaatagcttccagggaatagtgctataaggttactccatagtcattttcctaaagagaaagcaaaggcattttattaaaacttgacgtatacctatgtctttatagcaagaaaataaaatataataatagtaacaaaacaaaacaaaaactttacatataccagctcagtgccctaagtagctaggattgcaggcatgtgccactatgcctggctaattaaaaataaatttttgtagagtggaagtctcgctatattgcccagtctggtcttgaacacctaggctaaagcaatcctcctgccttggcctcccaaagtgctagtattacaaatgtaagccaccacacctggccaggggtgagcctttcttatgttgacttgaagtgtgagactccaagctagccaaataaatcattgggctacatctccagacaagaacaactctcccttctttcttttcaaatcacccaagacaatcttttcacttttctcccatcttccacactcccagttatccatttgtaagctgttgatttctttgggggcattgtccccataaactttttgtaaagcatcattgatttcaccattcttccactcaagcttcaccaaaaatttgatgtttgttcttgcttccattctagcagaattcacttcattctgatatgggagcttttcaaactatatttcctttttagtgcctcaaactaaatctgtttcagacatgttataacaagttagtatgagtttattttggtgcaaaacatttttgaacttcatggagtttgttcacaatatgcatttttcataaagttttttgaagacctcttgtatttatctcttttgttttcacattttatgtattttcatttcaaataaaaaatgtgtgattgtattatttttataatacaatgcattatattatgtgttattttttataaagaaggtactggaaacaactcataatccttacccatagagaagactataagtaatatcttgggaccatatggaatatatgttatatggttgttttcatttttaatacatgtggtttcctatttctcataggaaaatctagtatttccttatctaaacaccaggcatgacttctcactacctctttccagggaatgtggaatatataaaaataaaattaaatttctccctctgaagccagcccacagagtagttgacccagccctgtgtgcccttttctttgttctccaaaaagttgctttccggggtagcccattctgttcttcacttcaaaagatgttagtatagctgatgaacagctggacagaatgggaactgggagagaataaagtatcagtctaagggcctcactgtgccaatttggcaacactatagaagacaattcctctgctgtcagagagctggaacccatgcatggctggaaaagcaggaaggactctcttggccttgagcttctcccatgaagtcctgcctttaatttccctgtagatgtttattggagggtccaggctgagcgaaactggcccagctctcctggacttcatgggaccaggggagccttgtgttctagtctacatggattttctcttattgtctttttctcttgctttcatgtgatggagcttggtaaacatttctgagggaaggtaataaagcctaactgttaatacacttaaaacattgagggaaattgttgtctaggctgtgttgggactggaggctatttgattagccatagtcctggttcattcataccgctgcctctcaaactttaactgtgcgtaagagtcatggtgagaccttgttaaactgtagattctaatttagtaggtctgtaggggaggaggttgactgcatttctcacaagtcctgggaaaatgctgatactccttctccaagatgcatactttgaatagcaaggaaaagtaatcaaagtcacatgaccacagtggtcaatttcacttagaagagtgttccagaggaaacacagcaggccaagagggcagcatcaagcatatcatctttttggtgtgagtcttcatggcagtccaagggccaggctcctcctcccaccaaaaacacaggtgttgttgttgttgtagagactacaagattaagtatgggaaccatcctagcttaaaaactcaaagctccataggaaccaatatctgttataacagcatccaggtcttgcactatgggaagctcaaatctatgccttccctccaggtattcatattcattcacaatttgcccagtgtagaatcagtttatcaatcagatgtcattttcctcattaacaatgccattccacctttatcagggaatagcttccagggaatagtgctataaagttaccccatagtcattttcctacagagaaagcaaaggcattttattaaaacttgacatatacctctgtctttatagcaagaaaataaaatataataataataacaaaacaaaacaaaaactttacatataccaatttgttttaagttcatgagcatacaaggccaccaggaagtctacaataacctgtctgccttgcaattagagtgaggccatgtggccagtttgaggccatggaatatgattgtgagttaggtatttctctgagcaatttctcagccagctagatggctgcaggcagatgatccagtaaactttacttagtaaaggattccagggaagacttttggggatgatgaagcctcaaggtggagggagaacaatagaatgggcagagaggtgtctggtaagaattgtgtatgatataactaccttaaccccataatttattgtttaaaccagaatgcctaagaggcaaatggggggctcttttattaataaccataatgaattacactgagacaacaggcataaatggagattttcctagccaaaccatgacatataaggtcattctagctataatccctgttgttatcatccaagaaattcgtcagtgaaaaacaatgtgatttatcactgcgtttaggactgtgtgtatgtgtgggagggagggatataatgaagcattgaatctggcttccaggtagatatggggcaaaatcagagaccgttcatggtgatctattcacatttgagtagcatgaatgagaaaattcagggctacagaggagatgatgttccaatgtcacatcacaagctgatggttgaaccaggcctcaaacccttgatctctttctttctttttccactgttccactctgcctctttgcattagtcaggaaaataccaggatatgcagcagtgacaaataagccctgaaatatcaggggcttaataaaagaaaaatgtatttctcacttgtttgaagtataataggtgacaagtagccctgttaacctacaaggtggtaatggaggggaagactgtggaatattgcacacgggatattttttgggtcaggcatgggaatgacatatatatgtgtatatatatatatatatatatctatatatatatatatagatatatatatctgtatatataaaatctttctctctctagcactgctgtctgcattcgattaaccaggactcagtcatgtgacctgcatccaagtacaagtaagggaaatgtgctccttctgtgtgtccaggaagaggaaataatgtggtggacataaagcgttttctttgcacactttttcagaactatgctttaacaattgtgtaagaaactatataagtaaggttgaagtatccatgagtgcagcaaattgtcccccacccccactcccatccattgcaggagactgcattagtcttcttgggctgctataataaaataccttagactgggtggcttaaacaacagacatttatttctcacagttttgggggctgggaagtcagagatcagagtgccagcagggtcaggttctgatgagggcccccttcatggcttgcagatggctgccttcttgctgcatcctacatggtggaaagagagggagcaagctctctggtctcttctttttttttttttttttttttttttttgagacggagtctcgctctgtcgcccaggctggactgcggactgcagtggcgcaatctcggctcactgcaagctccgcttcccgggttcaacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctctggtctcttcttataagggaactaatgccatcacaagatccttccccttataacctcatgtaaatctaattacccctaaaggccctacctccaaatatcatcacattggaggttagggcttcaacatataaattctggggggacacaagcattcagtccacaacagatagcttctttcatttccttcctatgccccggatactctgcaattggaactatgcacatttgggttgtggcccacctgtgaatctgggagctgagatctctggtcatgtgtctttttgatgcatcagcttcttgaaatgcctacctttagagctcttgaaataaggaggatgaaggaaatttatgaagaggggtgtgaaatttatgaaaagtgattactatggcacgaagggagagaggttgtctgttcattcatttaacacattttttgagcactaaatgcaagacattattctagaactagagacacaagggtggacaataacaaacatgcttgctgcatgtttgagaaaaacatcctcaaggagttttttctcttatttggcaacatatacattatttttgtgtttatttgaataatatctaattatgggttataattagtgctatgaagaaaaggtactagtcatatgaatgggcacgatcggggcatccaatccaatttggggtatgtaaaaacttcctggagctagtaatattagattagagatctgaaagataatttggaagtagagtagtaattgatgatgtggtcaatgatgataatgatgatggcatttattgagaccttactatgtgtcaggctctgttttatgtgccttgcatgtattatcttgattatttcatacagcaggggtgtccaatcttttggcttccctgggccacactggaagaagaattgtcttgggccacacgtaaaatatgctaacactagcgtttgctgatgagctaaaaaaattgcaaaatacctcgtaatgttttaagaaagtttacaaatttgtgttgggctgcattcaaagccattctggtctgcgggccatgagttggacaagtttgccttacagtcattctacaatctagttattaatattaccccctttctgtttttttgttgttgttgtttaaagacaaaactagctggagaaaagagagttgcatttcctaccaaaaaggaacaagtacaaagaccctgtggttggagagaacatggcatatgacacatttgaggaactgaaggaaagtatttggaattatgctgtgtatgatgctaaaggaaaaagacttcctcctttcccatcaaagtgacaatgtgttggggagggaggagagaaggaaatgtggaagtttgtgtttcggtgttaaatgtaatggtctataaattatacttccatgtaatatgaacttatggaaattttgatttaaagaggttgtgtctggattccttgcaatggtactgcaagatctcagagaaatgtagacttttggaagatgtgtaaaaccccaattccaagagaaggggactcagattttgctagtattttccatcttttgaagctaaaaagttgggtatgggagctactgaggttttttaaagaacagagtttaaggagaatactcccactcaacctcatttaaatctgcaatgtgtattggggaagataacaattttgtataatacagtgatagcttatctagtctggctcagcgtgtttcacaggaggttaatgggaaagactttctcatctcagaaaatgatcagctctctttgaagttagaatttgagtctctatgctaggcagcattttgttttcatttcattgatttagatgtgaaatgttctggcatttcttaattctgcagaggaggtttgtttctttgaagctgagatgtatgtgtgcataattatatgtgtcacacacatattgacacatgtctacatatctgatggatccatgtgttcactcatttattagcaagtatttattcaacatctgttatatgctacattctgtgaatgcttcagtgagctcactaaataaggttcctgtttcatggccatggagttcacaatctgaaggtgcttatagacataagcaaaaagataaatgtagaattaaaaatgttattgactactaagaagaaaaacaataggttggtatgtatgaggcagaataatcagagtgtctacctaagaatgagtggtgtgtttggtagcttctgtttgtcccagcagccccttttcccacccttcctcgcccttcctgggagcctttctgcatcgactgctttaaagggttcctctgcgtccagtggggattggccattgagatggtgggtgaagaatgaggctgggttatttactttcctggctctctccacgtcatatctctatttgattgaaactctccactgaaggccatcaattctcaattctttaaggtggcccttacacttacactctccaggttctggtacattcccttccctcctgcttccggcctccccagctgatggtagccatagggtaccacactatctcttgttggtgtccctaaaccctgtccataactttgtatatggcttctttgtgaacattttaccccgtttggaatatgacacctgtttcctgccgaggccctgactgatgtatatccaaaagggtctttttgaggatgtggcttttaagttgaagcctgaaatgtcggaaattgtggaccagatgattaatgggaggaagtgggttttagaagaaagaaagaatatgtatgaaggccccccaggatggaaagaactttgtatgttcaaggaacatacagaggagggacctacatatagggacaaagggcaggtggtgctggatgaggctggacaagtgaataagcacagccacacccagcttcgtagatgctgttagggagtataagcaggataatcaatgacactgtgtttagctgagctgaaaagaatagggaagactttctggaggtggtggactttgagttggactttaatggacagatagaactgtattaggctgtggtattcaaaatagctgttctgagattaaaaaaaacttgtgcttgaatgtaaatcaatacattactttcttcatcaaggcagccttgcattgggccacctggcattcataggtaggaggtagagaagaagagagagaaagagaaatttggtaaagcaggtgcagtcaaaccagatcacagaagggtacaaatagtaggataaggagttgggactttatgctgtgggcaattgtgggacattaaattttctttttagaagaatggcaagattagagctatagttagaaagataatctagcatgatgtcatggctgggtagatccaagggaagaaagtgtggggcagtgatcagaaacactgtggaagttcagttctctcttttgtggtttcattaatttaacaagatttgttttatctttgaaatgatggctgtggcctaaaatgtgctattatttattgtcatcttcccatgctaatttttggtgatgatgctgacttttgatgaacaaagccaggagtcttcaataaaataaaacagaagtcttgagaacaaaagtcaattgtggtctgctaatttttagcatatttatttatttatttttggaagtaaggagagtgtctattctgtaaatgttgacttgggcaaaatatgaaattttacacagacctatcactttcagagtaatgtcaaaaggatcacgtagagaaatttggtgaattatcagcaggttagttgtagataaaagacagcaggctgggcacaatggctcatgcctgcaatcccagcactttgggaggccgaggcaggcggatcacgaggtcaggagattaagatcatcccggccaacatggtgaaaccccgtctctctaaaaaatccaaaaaaaatctgccgggcatggtgccacatgcctgtagtcccagctactcgggaggctgaggcaggagaattgcttgaacctgggaggcggaggctacagtgagctgagattgcaccactgcactccagcctcctgggctacagagtgagactccatctcaaaaaaacaaaaaacaaaaaacaaaaaaaaaacaaaaaaaagaaacaccacagcaattacttttactataaaggctgcaaataagatttatagaagagaaaggggtgaggtggagaagaagaaaacaactgcaggcagtctagggaaaaagtgaatctcgtgtgcacatattctgggtaaactaattagctggtatcaagtaaatatttcagggtggacagtatttctttgagaagacaggctagagatgtcaaggggaaccattcccattgtttatggattctctggaaagcctggagagtctggttgaggcacacatgtgatgggcttcttctctgtcctcctgcgtccttgccgcggcaccttcaccactttcttcatcagaacttctcagctatcaaactgatgttatcaaagtgatgggagtaacatagtgctgagcatactgtaggtgctcaataatgctctttaaaacacatgcacttatgggcacacacaaattggagtggtgacaaatgcctagtcacacgtcaaagaagcctgtagagcaagcatgtccaacctacagcccgcaggctgcatatggcccaggacggctttgaatgtggcccaacaccaatttgtaaactttcttaaaatattatgagattttgttgtgatttcctttttaagctcatcagctatcataaattagtgtattttatgtgtggcccaagacaattcttcttcttccagggaagccaaaagattggacacctctgctgtagatggttctgtttggtgactggctttagctaagggaatagagttatcatcagacctgatgctccaggctctttccctcccagctttgtgtgtgattcctctagaatatacatccatgcttcactcacatctgccgttaataacctgtcgatgggatctgtactttacgtgttctgtgatgtgaacattttggacctttttcatagaatactctcctatcttaagcctgcatacataattactataatttctttctttctctttcttttctttctttctttctttctttctttctttctttctttctttctctttctttctttctttctttctttctttctttctttctttctttctttctttctttcccttccttccttccttccttccttcctctctccctccctccctccctccttctctctctctcttccttcctttctttctttctttctttctttctttctttctttctttctttctttctttctttctttctctctttctttcttcttttttttttttgagacagagtcttgctctattgcccaggctggagtgcagtggcgtgatctcagcttactgcaacctccacctcccgggttcaagtgattctcctgcctcagcctcctgagtagctgggattacagccacccttcaccatgcctggctaatttttgtatttttagtagagatggggtttcaccgtgttggccaggctggtctcgaactcctgatcgcaggtgatctgcccgccttggcgtcccaaagtgctgggattacaggtgtgagccactacgcctggccttactatattttctataaggccagactccaaatcattctgaagtcacttcttgaagccatttcctattccctccgttcacaacagtctcccttctctaaatgcttcttaataaatttaccaacacatctcctatatatttattacttttgtcaattcattcagtaaacatttcttgaaagcctactctgttatttaatgaatgtttactaagtgcctttattattatcatttttttgagacagagtctcgctttctcgcccaggctggagagcagtggcacagtctcggctcattgcttactccgtgcccctgggttcaagcaattctcctgcatcagccttccgagtagctgggattaccagcacccaccaccatgcctggctaatttttgtatttttagtagagatggggttttgccatgttgaccaggctggtcttgaactcctgacctcaggtgatccgcctgccttggccccctaaattgcttggattacaggcgtgagccaccacgcctggccctttattattaaatatattattccattcatgacttgaagccattctacagatagggctgttattgccatgttacagatgaagaagcctgcacttgggaagattatgtggctttctagaggcagacagctaagtgggttagtaaggtgaccaaccattctgatttgcccagaactgaggggtttcagcaattgtgaactttcagagtcttgggcaagccagaatggtcagtcaactgacctagatttaaactttactctttgccgactttgaccttaggcaaatttcttcacctctctgaatctgttatttcatctgcaaattttggtcctgagaaaattaaacagatcacgtgtatacaatgattagcacaaaggaacaactcaaaaagtagcagctattattatccttaaaaggctttgggctgttagttatttggaaagtttatgcctgggatctgtgctttcagcaaatctaaatatgtgtggcctgaagtagaggtgacagcctcagaggctgttatcacgttcttttcctttgcaactatatagaagttagagagaaaggagaaagcagacatttaacaagcaattatacaattgcttcattaactgacaatattatgaagaaacaccgggttttctgtaaacctatggagggagataggagtgtgactgatctgggtagtccaggaaggcatctcagaggaggtgatttttactagctctgaagggcaaacagctgggtgactgtgagtatggagggttttaggtgctttcagtcagagggaatagcatttagaaaaaccctgaggctggaaggagcctggcatgattgagggtctgaaaggtggctcttgtggctggaatacagatagagaaggaaaggagaggctgtagtttctggctgtgattctggaccctctgtgggtccttgaatcaacctgactgtgccaatgtcaggggtattgtttcatcatcactactataatctgcgtaatcacagcacttgtccatagagctctcactatgtatcaggcacagtggtaggcaccttccatgcattattttataggaacttcccaacagccctgggagaatggcattgttatctttgttttactgataaggatactgaagttcatggagttccttgacttgcccaagtcatacagttagtaagtagaagaaatgagttggaagctaattccattttattgtacaaccccagtctctttataccacactcattgcttcttccagtccccctcttcctcctcaactccaacactcagcaaagtgcaaattggtatttgctcagcggattattgctatgattattattttggtcagcagatggcaggtttaggacatcacctcccctaaaagtggtacaaataaggaataggaaacaacaaaataagacatcctgcatcatgaaataggcatctacactataggaagatgaaatagaattgagataagctattggatgatggatccaaatgaattacctacaaatgaatattcaaggacagagtgaaatactaaggtaaatctgtcatctttgagtgacatcactttggccactggatgtcacgcaaaaattccacacccaaatcctggcttatgcattcagatgtttaagagctgcttcactaatttactgatgaacactttgtcatatgtaattggatataacatatcacctccttggttcgttgggaggactaaatgaaagcactcatatggaaatataatgtttggatacataaatgaattttgctttattattttaacttagccagtggttctcaaaatgtggtccagagaccctcaagtatccttgaaacacttttagtgagctcacgaggtcaaaactattttcaccgcaataccagcatgttatggttctttttcagactcattctctcctgtaagtggagcttttctgaggttgcatgatgtatgatatctgcaacggactcaaggaagaagcaggtatgagaatccagctgtctcatattaagccagagatagaagagatttacaaaactctaaaaccaatgttgctcttagcatttttttaaatgttattttttcataaaaatatgttaaactatttctgtaactctttacctattaatttattttaaaataataataacccatgaatcccactgcaacaggattattgctgttgttttaaaataaattaataagtacagattttttaagtttctcagtttttatttctaataatattcatagataaagccgtatgcacacaagttttttggagtcctcaatttttaaaaggctacggagttttgagaccaaaatgactgaaaactactgactacattaacgtttaggagacattgttgattctgtgctgcctactcccagtgcaataaaagtaatttgtaattaatccttagtaattctgacaagaaaatgccaacagcaatgatgtgaaggcatcctgctgcttttaaaggaagcaagacttaatatgcagagagttaagagctatttcacaaaaataattacatctgggttcactttaacccaagggcatggattgcaaaatgtaattagagcacattttctcaaatattaattgctatttctttaatagaggaaaatcataatagaaaaaaataaaaaaggaactccacctctcggaatttcactatgccaggcttctggccaagggcatgtgatggcttcttttcagcagtcttgaaggggtctcctcacaagcaaagcaatgcaatctgcattgtgatcctgattctgctatcagcttgctgctctccctgggttccattttcctcatggaggtagggagagagtatctcttgggtccttccttgagagactcatctgtattgagacatctgaaacagaatgaggagcggataaagagggcatttaggaagccaatgcagtgatggccaagaccaagactttggatttagtcaaagagaggcccataggagcccaaggagagattgtaggaaatcttgcatccaaaattccaggagggattaagggaaagtagtgggtatgtataaggagcaaagtaggagtttacttgagaagaagaagctgtcacatagttgatgagagcaggcaatccctgagtagcacatggccacttccaaatccagcaaggacattggggaggtccccttgctggcttatgtctaagcttgacatgtcatcctacaggaaacacatacagtctggctccactttctgacagtacggtaacttcttttgttaggttatggactggaatctgtttataggcaaaaatcttaaaaggaagaaacatatgccaaatgttggtctcagtcttgcgacacattcttgtgtttatggcatcatccagtgactcagcgttgctttttggatagggtacaaatgcttcatggtctctttcctgctgtctttgcaagtttgctcctgagggcttctgcaggcacactctccccttcagctgatcgtaacgacttcagatcctttaagtcccaacggagctcgctctcacacccaagcctttgcacatgctggtccttctacctggaggcccattcccctaaactggctgactggctagctttcaagttctcagtttaaatgtcatcttcttagaaccaccttccctgcagactaaagtaagcttatagtttatctacctccattattctctctcatggtacctcgttttagggcttcataatacctatcatattttataatttttgagattgagtatttttggaaattaactgccactttatcaagttaaaaaacatgctgaaggtttataatgaaaacagcagtgctctgcctatgaatctctacctcacttggtcctgctctccagagaaatcacttggaactgtgctagctgtctcttctaatacatgcctcagtatttctagcaaatatgcttatattgttatatattgatttattaatattagacttctactgattttctgctataaaaggaaaatttagatcttctatacatctcttcatttctcctcttgctttaatattcatttcacaatttttggataaatccaaatcattgtttatgtttttatgattatacaaaaattatttgcagagtccaagtagtatactaggatcatatattttcttgtccaactttattcttcctaaaattgcctgtttacctccagttggtgttgtttgttctacatttatttttatctttttttcacccattccatcagatcactaattagtttttccttttaaatcaggcgttggcaaactctttctataaaagatcatatagtaaatatttttagactttttggtccagacagcctctgttgcaactactcaactcagctgttaaagtcatgggcaatatgcaactgagctgcagacaatatgtaaatgaaggggggcagctggccatgttccaaaaaacctttatttacaaaagcaggtggtaggcaggatttggtccacggactgcagtttgtcaactcctaatcaaaatgataaaatagaccagatattatttttttgtaatgctttactttcccaaagccctgtcctagagcccccttgcctgcgttgctatctgtactgctggttctctttgtgtcctaccctgctggcatcctggaacttccccccactgttttcctgttttagaccccttgttttttggacctccgcacttcctctttcttgtttcattccttggtttagctggaggatattctcaagtaacctcctaaaaaagagggtgtaaaagggaggtaaattttccgagtctttctatgtctggaaatgtctatatgttcctcttatgtcttttgatagcttagctaagtaatgtattccagataaaatattttgtcagaattttgaaggctttcttcagttattttctgacttctagcatttctggcagatgactgattgccattctgattcctgtttgtatatgatcttgatcttcttctctccttgccctcaaccctttgtctgagaggttttaggaacatgtctttatccctggagttctgaaatgcatgatcatgtaccctggcgtgatcattttcaatctcatgtctcacttgtgtcccagtctgtgtctgatgtacgtgagtctggaatttcttcaaaagatttctccagatgctagctttcctatcttctgtctgtggggttgccatcaggctctgtggggccaagggagggaatctaccaatttaactcttcctgcattcaaatgtgcggcctcatatcttgctccttgcctctgtgggcatcaggtctctaagagccacactttgcaggtatgtgtagggttcatgagaatgattatgttcaacattctcctctccaggcttgttaagttgaagttttctcaacttttcaacaaagttgattattactcatgtatctattccctgtctttcaaaatttgattaaaatttgttgttcatttataccttaaaataatttttggttcattttattgggagaagaaaaagatataactgcttatgacctatctgttgtgtttaaccaaagttcacaatttgtctctatgtatgtgttttttcttttttttgaaatgaagtctcactctgtcaccctggctggagtgcggtagtgcaatcttggctcactgcaacatccagttcccaggttcaagcagttctcatgccttaacctcccaagtagctgagactacaggcacccaccaccacacctgaataatttttgtatttttagtagaaacgggactttgccatgttggccaggctgtctcgaactcctaacctcaagtaatctggcctgccttggcctcccagaatgctgggattacaggcatgagcaaccacacccagcctatgtatgtgtttagtggtctaaagcctgtctgctttcctgctaggaagaggctgtgtctgtttattcacccactgtatccatcacacctggctccaagtgggtattctacacatatttgacaaatgagggactacatattgagtgaaatggtttgaggaagaggcctcaggtgggagcccaaggagacgatgctgggagacactgatcctgttttatgaagagccttgagtactcagggcaaggagagtgaattttttcctggttgggagcttgttagtattttttcagtggtgggagaggtggtgatggtagggtattttgatcaaagcaatttcagaaataacttttctggttgtggtatgaaggctagtttgaaaagggtacacatgtaggaaataagatgctatgaaccgacgagagcttttgagaaaggaagagtgggactgcagaaagtttagagaagaaaaatcaataggactttggttctgatttaatataggaggttaaaggtgattctcaaaaacgcttccatccaggcatggtggctgacacctgtactcccagctctttgggaggccaaggtgggcagattgcctgagcccaggagttagagaccagcctgggcaacatggtgaaatcctatctctacaaaaaatactggttaaggacatggtggcaggtgcctgcagtcccagctacttgggaggctgaggtggcaaagtcacttgagcctggggaggtggaggctgcagtgagcagtgatcacaccactgcactccagcctggacagcagagtgaaaccccatctcaaaagcaaaatagaacaaaacatgatggttgtcttagcagaaagaaagaatatgaaagattttggggggatggggaagaatagataatggttttcatttgtcatacttgaggcaataaaggaacgtccaagtggaaatgtttagcaggcagttggctatattagaggtgggaaatgaaaacaggttagagagttgttctcgcagagtaattcaagaagagaatgacatgaagaaagatgattacttgcttaaggtcataaaactgataattggcagggcccacactggaagtcagatctggctaaactcatgcctcatgttcaaccacaatagtgttctgactctacaactttgttgagatgcagccagaagaacagagacttagcactggccttggggaatactcacatttaacaaggcaaatgacttcttaagaatgaaggtgcaaaatgcaatcgaaagctaatgaggtatgaggggagaatactgatgctccaagaatgccctaaaatctggacaggagggtaggaactggtaccttgggccaggcagcttggctaggcccatttggctttagcgagggctgaagtctcccacaggcgcctcctgctttcactctgaggacttctccaagaccatcagttgcactttcttttcatacactttccattctgcccactgctatggttcaagccagagaaaactgtggccaagtagcaattctgagaacataagcacggctgacatcctgcctggtttcttccactcttgctcagcccagagcagcctgagagaattttggtgaagtggtgtttggggattttcagaagtgcccttgcagggaagggctcctgggctcttctctgccctagaccccctccctgtcgcatgccttcgggttcatggcatgggctgggggaggaagaggaagcagatgccatgagagtgggggcgtgggcatgtaggttgtgaaacaatatgagaaacctccagagccagcaaagaaagttttatttttggaatttggaattcaaagtttttcacactcaacatttctgtgactagcaggtgagataaaaatctatgtcattccactggttttcacctttgttttaaattatctgattttaaacagaaattattatcagtctgatattgtttccttttctaaaatgtggtttaatttcgtaaagagccgagtaggacggcagagctgaatcataggaaatgtcagcatgcaagctctacacccatgattacaaaacggtgttctagtaaccttggtgctctccttgaaaaagcgttccttaatcctaggtttttgttttcaactaggcaaattttctctttgtttgttctaccatatgatgtctttaatttcatgcgagagaactaatcatggatcctgagtttgaatcctactttctcctcttccttcctgggtaacagtgggacagttacataacctctgagccttagttgtctccctataaatgcaaataagaagatggacgacacacacacacacacacacacacacacacacacagacacacacacacaactggcacttagtaggtgctgaaatcttcttacttcctatcattgaacaagattggataattttttttttcttttggcggtcactgactcaccaaagaaaaaagaaaaaatatcaatttactgtatgttgttaaatcaggagagacaattgtgggtgtttgtgttttggatcttatttttagacattacaaaaatgttccatgcactggattttgaaattaagaatgaggaaacattatttatatctgaatcataaattacaacaaacgaaaatattacacgtatgatttcagttctatattacaggtatttaaagggaagggagagagggaaaaggaagggaaggaaaaaaggggaggtagcaaacatacaaaattggcagagatatgaaagacatggcaaaggtaagagacagtggatgtaggtgccattgtttgcagataaatatttttggttttcccctaattaatacttgatctatgggtgctagagttatgtatttgctgctgtaacttctctttgaaacccatctattcatccattcatttatctgcccccctttcattactgtttgatttaataaacaactactcaatatatcctttgtgtttggccctttcctaggtgctagcaaggcaagaaatcaagccaaccttgctttcccagagctcatagtcttgcaggagagacagacaagtaaacaaatagcagcagagaataataagtgactgacttggatttggggtggtggaaagtcttcatagaggaggcaattctatgctaagacagtgtggtgggtagttaagagcacggatgttacaggcagatagatatgggtttaatcctgatttactagttgtgtggccttggtcaagctgtttaacctgagtcctcacttcgtatttaaaaggaggataaaacacagaaacataaagtttaggcaaattgtgaataatacacataaaagctttgtatgttgctaggcacatgatagaccctaaaattgaaaccatgattttcatttcaaggtacgggatctttagtttattagagtcttagaggcactctgggaaagttggatggggttgagagaacgtgtctctgtggaaaaaaatgggttatgtactattactgacttttcaacatttctgttgaaactttttgaaaacttttctgaatcacagtagcttaagtatcaatgttgaaactttgctttggggtgcattcccctctgtatttcctaaggttggaagaaatcaaaccaagggtgggcgattgactatctttatcgtagattacctcttggttaaaagaccctaaagcattaactcctgagattaactctaaagcattaacttccaaagctctttggaaggccatcagcaacacctgcagtgcaaagctgttgtcaagcctgtaattatgagtagcaccaagggtaccaaatggtgacgatattctagatctggtttcactctcttagcacagacactcatatacaggatgtagagaaagcaagtaaaaccctaagattaaaatagaaatggaaagtaatcattttttaacaaagaccactctgaagttagctgtttcttccacaggaataacattaatcactaggggatagaagtgtaattcatatcaactcattggctctccagtttatagttgtttcttctcatgtaatggcccctgtaacgcagtggccagatttcctcgttgtccttgtgcccatggccacagttgattctaaggcagttgttctcaaacaggagtgtgcatcagaatctccttgttacaatagagttctggatcccatcaccagtgtgtctgacgcagcaggtctagggtggagcttgagaagtttcatttcaataagttcccaggtaatgctgatgctgcttatctagggagtgagccttgagaaccactgacctaggagaaggtaactgagctctctgtgttcttccagtgcacccaccaccttccatcctcattccaaccccacttttcacatgttttccaggtatattttccattggttacaaatacaataattttaataagtactggaggggagcttgtctacagcctggagaagaaagggaatcaaagtgtgaggggaacatcaaggtgttctctaacatcagaaatctgtgtgtcaaaacaagaataggaggtagatcttttcaacctgccaattttccctccctcaaaggaagacatttttaacaatttttaaatgtctgaaaataggcagcttttggttaaagatgatatattaaacaaattcatttatccttgcaccttcttaaataacaacacaatgctagcagctaaacttttggcatagtgtgcagcataaaccctcaaggacaaaaagaagggtagaagggatgataagaatattgaaaataagaaagcagataggcaactgttccaactggcttctgtagacctgggaattctgagctgtaagcagcagaagctggagagcgaggggatttgcacaccagagccccagaaaagttctggattctggaacttctgaatgaggtaaaattgggcctaaaaggaggagtgactgagaatctgtataaagagcaagagaacttctaggtccaccctacccactacatcaggtgatgtcttctcctttgccctggcatgtagctggaggtttactctcagaaggcagtgaatcagaagagctctggactggtggacaccaggcacagttggaagaaggggtactttatagaaaatggttgggggattaaatgaaagtcaacttatggaaactttacactttagtcttcttcccaacttgagctcccagaatgttggcctccaagtgtatgccttccagattagtagcataatgctgcgattttagaaggtacaatcttctaacaatctgtagctattttcacaaaaagattgagggagaatggaaggggtttgtggtgcaagagaggcctgcagaggatgtccaagctgagtttaaagtcagccatatttactgagcaactattctgttccaaataacaagctgtgagctcagatgattccccaataagaaagattcagtgtgcccatccctcattgaattagatgggaaggttggaggaaggaacagtgcatacagagggagatggtggagaaaagacatgctgagtttgtggaacaacaaacagttcagtattgttggcatggaaagtatagatgtgtagggagtatgggagggagggagggaggcctgaaagatgctgctttgcttatgtccctctctttctttgtatgtgttctgtcacaatgcatattattttatatgcatctattttgaatcttcataaatgtaatccattctcatttttaacttttttcatcaacggcattttttttttttttagatggagtttcactcttgtcacccaggctggagtgcagtgacacgttcttggttcactgcaacatctgcctcccgggttcaagcgattctcccacctcagcctccccagtagctgggattacaggcgcctatcgggggaacccacccccaatatttcaacgtaggttctttctattttccataagtgtcggctggctgagaaataaagagtaagagtacaaagagaggaattttatagctgggccgctgcgggtgacatcacacatcagtaggactgtgatgcccacctgagccttaaacaagcaagttttttattaagggttttaaaaggggagggggtgtaagaacagggagtagatcacatgcttcaaagggcaaaaagcagaacaaagatcacatgcttctgaggaaacaggacaaagggtaaaaggcagaacttctgacaagggtctaggttcagtggtgcgcatattgtcttgataaacatcttaatagaaaacaggattcgagagcagagaatcggtctgaccaaaagtttaccaggatggagtttcctaatcctagtaagcctgagggtactgcaggagaccagggcgtatctcagtccttatctagactgcataggacagacattcccagagcggctgtttatagacctcccccgaggaatgaattcctttcccagagtattaatattaatatcccttgctaggaaaagaatttagcgatatcttccctacttgcacatatgtttacaggctctctgcaagaagaaaaatatggctctttttgcccaaccccacagtcagtcagaccttatggttgtcttcccttgttccctaaaaatcattgttattctgttctttttcaaggtgcactgatttcatattgttcaaacacacatgttttacaatcaatttgtacagttaacacaattatcatagtggtcctgaggtgacgtacatcctcagcttatgaaggtaacaggattaagagattaaagtaagacaggcataagaaattataaaagtattattcaggaactgctaaatgtccacgaaatcttcacaatttatgttcctctgctgcggctctagccggtccctccgttcagggtccctgacttcctgcaacaggtgtctgccaccaagcttggctaattttttttaaatttttggttaaatacaaagagatgggcttttgtcatgtcagccaggctggtcttgaactcctgacctcaattgatctgcttgccttggcctcccaaagtgctgggattacaggtgtgagcccccatgcctggccaagggaaatctttttttttaaagatccatttgtgttgctatgaaagtaatctaagccatttctttgaactcatgcctgatattttatggtattttatgatgtggctttactgatttttacctactcattcttccaggcatggttgtcaaagttattttccatctctcccctgactccccagcactcgctccataaaaagaaatatagcaatgaacatccccaggaatgtcctctgataaaactatatgagaattccttgtgttatataccctggagaaagactgctgctgtgtgcatatggattgaggctaaatattgacagtttgtcctctaggatggctgccttctgggtggtccaccatggaaatggtggccatgatattccccattgctgctaatctagtttttttcacacagttttagatttttggctagtgcaaatgtcattttctctgggtccaaaatatcatttgcacttctctaattgctaacgattttgaacacctcttcataaacttgttagcttttgaggctttctcatctgtaaattgactgtttatatcctgttaccatatttctattaatattggggcagctatctatttcttcctgatttacaaaattttcttatgtattttagatattaagcacttgttgactttagaccttaaacatgtactttttcaatcactcatctatttgttaacattgtcttcttcaactttaattatcttcttcattaaacaaaaatccttagttacaatataatcaaatttgtcaattttttatggtttgcgcttttggaattttagcttttgcatacctaggttacaaagacatttttccatattttctcctactaactatagttttagccttcatatttagattttcaattcttttagagtccaccttttgcatgtgatgttaggtggggattcagatatatttttctccacatggtaagtgtatcagtcagacctattcagaaaaatgcatgtcatttttagtgtttacaacaaaagaaatttaatgcagggacttcgttacgtgaatgatggtagatctggtgagttaaccaggagatgctgaggcaacccagaccttagcaacagcaagaagccactatcactcttaggcttaatagtaaagaacaggaggagccaatgttactggaacttgggactacttggtagaattggaattcatgaaggagtttttggagggaatgggaatgaacaaagggatgccactgctgccataaatgtcatcaaatgcatgaaaagtaggagagagtaccctggattatttcttcctctttctctgcagtcttctccattgcctcccgttggcctcactggatgaagggcaggtgacaagagagactaggaatgtagcctgcagcctgcagcctgcagcctgtgatataaagcagaggagggcaagaactgtatttggggtcaaacaggtccagggtcagcacagtgggctgatatttcccaacatcatctgctagaaactactctttcccattgatgtatggtgtcacctttgttatatattaagccttcaaatgtacatgaagtctatttagaatctatctgtaaatatagactagattctaaatagacttcatgtacatttaaagacttaatatgtagactctaaattagagtctatttctaaactctctattctgtttgatttgtctatttatctgttctcatgccaattctattttcttttaattactatggctttatagcatgtcgtatctagtaggggaaatcccctttctttactcctctttttttaagtcgacttaaatattcatggacctttattcctctatgtaagtttttagaatatttccatttttcagctcttctgtatctattattattttaaagttttcctcatggaagtcttaggtatgtggcagcagaagaaaaaagaagtataaatagtatactgtctcggaagtgagaagggtcactttcactcacatttctagtcatagtaaggcacatagtcacactcaatttcaagaggatgaggaagtgcaatgtttctggtaggagaattggaaatcattggtggaaaacattaatagtgaccaaagtctgctattctggtcagcaaatatttagttcactgaccttcttacatgcaaaagacaatcatgccaccccaagacagagagaaaacacaacagttcatacagtctctggaatcagctaaaagtccaaagtagactaagtgatgctaggtggcctctttactagatctggatgtgccttctctcactctggtaatttgtaaactaaaaggaggggttttctatgctccccttctcacatacctaatatacagagaccacaaaaccaaaataactcttcccattggaaaggaaaaagaggggagatacataactaggtgtattcttaatgaaatgaaaacatatatccaacaaaagcaattgtacataaatgttcctagcagcattttctataatggccaaacataatgttaatgtttaacaaatgttaaaaacattatattatgctaagtgaaaggagccagtcacaaagtaccacatattgtatgaatccatttatatgaaatgtaaggataaatgggtgaattgtatggtatgtgaattatatttccataaagctcttaagaaaacaagcagacaaaaacaaaacaaaacaaacaattattggtctactgcagtttaaatgagacatatttggctggagcatgagtgattatatcagagctgaagactgcctttcaattgcaggtcctgcctcaagatgtagccaccgagtctcagaaaaagaaaaatgaccttgagacttgagacggcataacctggtgttgagtctctgtgtcatatatgctcacttatggccccacggaccactggggttatcttgccattaaatctccctgacttcattcacaaaccccacccttaattatttcctctgctggggataatcttcagttataagcacatgttattactattattatattttattttattagatgagtaagaagtgttttactgttgaaaaattggggctgaatgtgatggctcatgcctgtaaccacagcacttcgggaggccaaggcgggaggattgcttgaagccaggagtttgagacaagcctgggcaacatagcaagaccctgtctctataaaaataaaaaaataaaaaaaaagaaagagaaaaattggaaaatactcaaaatgacaacaaaattattaaaaatcacttacaactctgcacctagaaataactacagtaaatctttcaggatgtatttcagtctctgaaacggaaaggctaggaaaatgtaagcaaccttatgacaaacaacactcccatttttaccccagtgttctgtattaatctctcttgtagaactttctacattttactatagttatttttcagggattagtagaacaggagtcaattgacttatgttttagttccatctttgatttgccaaatctccttttttttttttgtttgagatggagtctccctctgtcaccaggctggagtgcagcggcacgatctcggctcactgcaacctctgcctcccaggttcaagcgattctgctacctcagcctcccaagtagctggtactacaggtgcacaccaccatgcccagttaatttttgtatttttagtagagacggtgttttaccatgttggccaggatagtttcgatctcttgacctcgtgatctgcctgcctcagcctttcaaagtgctgggattacaggcgtgagccactgcgcccggcccagctttttttttttttttgtagaaaaagagagaagaaattgaaaattatgacagtgggtttggagtttctcctgtaagtgattgggagccattgaaggattacaagtagttgaataaatcaaaatagtttttgagaaggaagtttccctggaagaatgatgcatgagtgtaagtgaatgagaataacatttacaggtatgctattgtactaaacttattatttatgatattttacttgatccttttggttctatagcataggggtaatcatcctaaggactaggctctggttttttttttatcttgcccaaattcctatctaaggagtctgtggagtcatgcccgacaaaccataaattctcatcagatgggttttatttaaccctatatatcgtgactgactttccaatatgactctggcataacattatgtgacaaagaaggaagtaaacatattttactttgtttgtttgccattttttgaaatggtcctgcaaagctgtcctttgtaggggaaaatgtgcatctgtaaagaatctctattaacatagccagatatttttcttccaggccctcccaatcctgaagagattaagtaagactctagcaccttttaaaggtctgaataaaaaacatttgtcatctattgtctctaagggcagctactatatgacttcaaaagaaccttggtctccacaatcttttatcttaacctgaacatttcctttcttttgatcccaggtctttagacaagctcaaccaattgtcaatcagaaaatgtttaaatttacctgtagcctggaagccccgcctcccctgccctttgatttgtctgtcccacctttctgaaccaaaccaatgtatttctgaaacgtatttgattgctgtctcatgcctccctaaaatgtataaaaccaaactgcaccctacccaccttgggcacatattctcaggacctcctgagggctgtgtcataggccgtggtcactcatatttggctcagaataaatctcttcaagtgttttacagagtttgactcttttcatccacaatcccccagttagagataagaaatttaaaacttggctgggttaagcaatgtgctcaaggacacacagctaataagtgttatagtagggaattaaatctagcatgtccaactaactggtttctttctaggcacagaggttggctcaagaggtatttcagcagtctgggtgggctctgttcccattgcataatgagaaattataatagaatatttagcaagctgcattgttgaaacagcagattggttgatggctgtccccaggggtttttccctatgactcatatacagttggggaatcctgaggaaagctcagcttttacttcttgaaatttaaggtcctgacactctgaggtgattgcagacagagatctgagtcgttgacaacaaagagattaagggagggaccttgggtaaatccctttgtccctggacctcagttttcttaaccacaaacaattaaatgatctctgaagctttcttttgttttaagactcaaggataatactgagtgcctaatgtaatgtgaagttctatgtagaggcttaatgatagcgttactcatttatagggattaaacagaatgtccacaaagaactggttgaaaataggctgcaaaaatggtacagaagatatgtgttcttagttactcaagttttatgcattcactagactgtaagattcaggtgggggtgggctgtatgcttgttcatcctacatcttaggggccatcactagtgtcttgtagatagggagccaaacaattttgttgaaagaaagaacaaataatgcagaaaggctgcttgtccccgagtatttgttctccacttcttcctcaataatgcaccacctagaatcacctggatacagaagcccagaacaaactacatttcccagacttccttgcagctagatgtgctcaattctgaccaatgggatggaaatagaattaatgttgactttttttttttccaggaaatcttagagtgagaggacataattttctccttccaatatctccttctggctgactaagataaaatggataaatgggtaagatatttggaacttggatcataaaatggagttacatgttgagaattgcagtgcattgagaagcatggtgtccaggttatctgccaatagtcaagcctctatgcaggcttttaactgtgtatgtttacataagcatgagagacagatatatttctattttgtttaaaacactcttatttttggtttacaaattgttgtagctgaacttaatacacgggaacattttcaaaagagggctgggcacagtggctcactcctgtaattccagcattgggaggcagagttgggaggattgtttgaggccaggagtttgaggccaacttgggcaacatagtgaaatccagtctctgtaaaagacttaaaaattagctgggcatggttgcatatgcctgtagacccagctacttgggaggctgaagaagaaggatcacttgagcccaagaggttgaggctgcagtgagctattatttcaccactgcatgccagccagggtgacagagtgaaaaagtctcaaaaaaaaaaaaaaaaaaaaaaaaaagaaaagagtacacaactttcataatttcataatttttctttcaagaacagctaataaaaatattttgagcttgcttaccataaacttcacaatcatgtatggtagatttgattttgggtgatgatcagggagtgcctacctagttggccactagttaatttttgtataaatacagggtttgcttgatcaacaacttgaatattttatactaagtatctaaactaatccttttattttcactgaaaactgttatatttccattttttacatgaggttgttaatataaaaccaatttgtttttgtgaatgaagtgaggaaaagatccattttttttttgaaaaaagagatagctcattattccaaaccacttaatttatagcatttatatacatatttttgctgctgatttaaaatgtacatttatcaaatgttagctacttatatcaacatttatatttgaaggacaatgactaggaattttatgaatttcataaaaaatataaattcacagatccaagatactcaataaacctcaagctgaaataacacaaagaaagccacacaaaaaacccatattaattaaattcctgaaaacaagtgaagagaaaaaccttaaaaatagaaaaaatatgcataaagaaacaaatatacaaattaatttcccctcagaaactatgtatttcagaagaatggaaaaacatctttaaaatgctgaaagaaattataaacttaaaattgtatatctgaccaaaacattattcaaaattaaaggcaaaataattttttttttctggaaaaaaaaaaaaccagaaaatttgtggctaggagacctgcataacaagaaatgttttttaaaaatttaagtccttaaatggaagaaaaataagtgatgaaaacttggatctacacacaaaaataaaaagctccagacatggtaaatataaaatacttttttatttgttaaatttatatagttcttaaaaataattgattgtttaaagcaaaaatcataccaatgtattgagaattttaagctatgtaagaataaattttataataaaataactcacagtatattaggaagtgaatactgttgcaagattttaaatttatatgtgaagtgatataatgttaattgaaagtagactgtgataaaattaagatgcatgttatgaaccttagtgaacaaagaaataaacaaaaaagtatagcttataagtcaatagtggatttaaaatagaatgatagaaaatatgcaattaatccaaaaggaggtaggaaagaagaaaaaggggaagaaagagcatatgggataaattcaaaacacataacaaaaagataaatttaaacccaattatgtcaataattatattgagtataaatagtctaaatgctcccattaaaaggcagagatttcagattggataaaatgcaagaccaactatatgctgcttataaggaaactatttataaatatacagataagttaaaatgaaaagtactgaaaaagatacaatatgcatataccaatcataagaaaggtggactggatatattaatatcagataaagtagaattcaaaggaaggaatattatcaggactaaagagggatactttataatgatgtgaacatcaagaaaacataaccatcctaatttgtacccaattaacagagctttaaaatacatgaaacaaaaatgaacacaactcgaagaagaattagacaaattcacaattatatttgtagtctccaacattccttttcaagtagtcgacaaaaaaagacagaaaatcaccaaatatagaagaattgaacaatatcaaccaaattaatctaattgacattaataatagaactctccacccaacaactgtagaattcacattcttcgaagagctcatgaaacatttactaaggtagactgtccattggatcatgaaataattctcaataaatttaaaagaactaaaatcaggcagtgtaagagcatattatgtatcaacagtagaattaaattagaaatgaaaaacaaaatgataatacccaaattatcatttttttgtccaaaaaacgacacacttctaaacaatccatgggtccaaaaagatgacagaaaggaaactagaaaatattttgaactgtaacttagaattttatctataaatgttaacattagaaaagaattaaaaattaagcttctacctttaagcactgtgatagctgcttccctcaaattttgatatgttgtgtttcattatcatttcattcaaaatgctttctagtttcagttgatattgcatgttttggggagtgacagagatcaatatcacccttaaagacctaaaggacacaggttaggtggtctccatcatatctgcatcaattcatcaggtggttccctataaaatccaggtggtttccggagaatgacacacagtactacaaactcagcatagcaggaaactttatttcagctgttttacaagatgttgcatgttttatagaataaattaacaaggtctgatatatggcatgtagccactggtatgacaaacgtgttcttttccattcctgttagaaaagggaatgaaatgcagtttgtattcacttggaacatacagcagtatatgtttagtcttgccccagggctatgttaaatctcttgacctctgtcataatgtaagtctgaggaaatctgaaccatctgaacattagaaaaaatatcacactggtgtatttatgatgtcgtgataattgggcaatataagcaataactgttaagtacactagaggggctgattagacatgcactccagggaataggagataaatcctatgaggactcataggcctactacatcaaaaaaattcttagaggtctaatttattgagtatgctcagacattccctccaaaatgtagttagaatgattgcatctcatacttcccaccacaaagaaggaagcatatctgccctctttgggttttggaggcagtatattccacactgggaatattactattgactgatacaaaaggcttccgggtttgaggggagcttgcagctagaaagtgctgtacagcaggtctagattttggtgcaaaagtccctgatgcttggaccataaactcccacaactatgccatttgcaatggagaattacactcctagaaagacagttcctgtttttctacttggaagcccatgtagagatagtacacattaccgtgggtcaagtgaccttgtggccagcactgccatcatgaaatgaggtcctgatttctgtcagactcatcaagttataaggttgtgtggacccagtagcaatccattgtaaggcagaagtagtagtatgggataataagtactaaggcctgagtctacctacacataagctacacaaacatgtgactcagatccccatgccatgtaccttcattgcattagcatctctcccttagtttacacctatggatgcataagtgcaggtggatggtgatgaggaagtctcttatgataagctcaggaaagaagtaaaaacctcagcttgctttaatgatgggtggcttggtacacagaagcaagctaagatggacaacaactgcattataccctcacccagcagaaacagcagtgagagaaagccctctcactgttttgagacaatgtctcaatgttttgagacgaagtccaatgctctgtctcagttctattcaatgaagctgcctacagctgaaagaaaccagaaggagcatgctatgaaatctgttaatttgagtgttcagtggaaggtgattgggtgaaagcagacttgatgggatgacacgcttctgagtttaggaggggcttctgagcagagccccaaatggtccggagctgtggctcaagtctggctgcttgctgctcagagaccaaagacatgaagtgaggtgtggtgaaaggaaaggagttttattaaccaaatgctagcagttgagggatggccaggctcatgcctttgaaagaccattccaacattttcagctgagtgaaggggtttaagaaggaaaaggtgtttctaggtattttattttctttgaagcaattgtgaatgggagttcactcatgatttggctctctgtttgtttgttattggtgtataagaatgcttgtgattttgcacattgattttgtatcctgagactttgctgaagttgcttatcagcttaaggagattttgggctgagacaatggggttttctaaatatacaatcatgtcatctgcaaacagggacaatttgacttcctcttttcctaattgaataccctttatttctttcttctgcctgattgccctggccagaatttccaacactgtgttgaataggagtggtgagagagggcatccctgtcttgtgccagttttcaaaggaaacgcttccagtttttgcccattcagtatgatgtaggctgtgggtttgtcataaatatctcttattattttgagatatgtcccatcaatacctaatttattgagagtttttagcatgaagggctgttaaattttgtcaaaggccttttctgcatctattgagataatcatgtggtttttgtctttggttctgtttatatgctggattatgtttattgatttgcgtatgttgaactagtcttgcatcccagggatgaagcccacttgatcatggtggataagctttttgatgtgctgctggattcggtttgccagtattttattgaggattttcgcatcgatgttcatcaaggatattggtctaaaattctcttttttggttgtgtctctgccaggctttggtatcaggatgatgctggcctcataaaatgagttagggaggattccctctttttctattgattggaatattttcagaggtaccagctcctccttgtatctctggtagaattcagctgtgaatctgtctggtcctggactttttttggttggtaggctataaattattgcctcaatttcagagcctgttattggtctattcagagattcaacttcttcctggtttagtcttgaaggactcttcgaggagaactacaaaccactgctcaatgaaataaacgaggacacaaacaaatggaagaacattccatgctcatggataggaagaatcaatatcatgaaaacagccatattgcccaaggtaatttatagattcaatgccatccccatcaagctaccgatgactttcttctcagaattggaaaaaactactttaaagttcatatggaagcaaaaaagagcccgcatcgccaagtcaatcctaagccaaaagaacaaagctggaggcatcacgctacctgacttcaaactatactacaagcctacagtaaccaaaacagcatggtactggtaccaaaacagagatatagaccaatggaacagaacacagccctcagaaataataccacacatctacaaccatatgatctttgacaaacctgacaaaaacaagaaatggggaaaggattccctatttaataaatggttctgggaaaactggctagccatatgtggaaagctgaaactggatcccttccttacaccttatacaaaaattaattcaagatggattaaagacttaaatgttagacctaaaaccatgaaaaccctagaagaaaacctaggcaataccattcaggacataggcatgggcaaggacttcatgtctaaaacaccaaaagcaatggcaacaaaagccaaaattgacaaatgggatctaattaaactaacaagcttctgcacagcaaaagaaactaccatcagagtgaacaggcaacctacagaacgggagaaaatttttgcaatctactcatctgacaaagggctaatatccagaatcttcaaagaactcaaacaaacttacaagaaaaaaacaaacaaccccatcaaaaattgggcaaaggatatgaacagacacttttcaaaagaagacatttatgcagccaaaagacacatgaaaaaatgctcatcatcactggccatcagagaaatgcaaatcaaaaccacagtgagatgccatctcacaccagttagaatggcaatcattaaaaagtcaggaaacaacaggtgctggagaggatgtggagaaataggaacactacactgttggtaggactgtaaactcgttcaaccattgtggaagacagtgtggtgatttctcaaggatctagaaccagaaatacaatttgactcagccatcccattactgggtatatacccaaaggattataaatcatgctgctataaagacattcacacgtatatttattgtggcactattcacaatagcaaagacttggagccaacccaaatgtccatcaatgatagactggattaagaaaatgtggcacatatacgccatggaagactttgcagccataaaaaatgatgagttcatgtcctttgtagggccatggatgaagctgtaaaccatcattctcagcacactattgcaaggacaaaaaaccaaacaccacatgttctcactcataggtgggaattgaacaatgagaacagttggacacaggaaggggaacgtcacactccggggcctgtcgtggggtgggggtaggggggagggatagcattaggagatatacctaatgttaaatgacaagttaatgggtgcagcacaccaacatggcacatgtatgcatatgtaacaaacctgcacattgtgcacatgtaccctggaacttaaagtataataataaaaaaaaaagaaggaaaatgtgtgtggaacatgcgggagtggtgcactagggtgcgggtgcaggtttgcacatcttgttccaatggctgtcttcagtaattgcccatctggaggtctggtttgagtcaccctgacttcagcccggtagtgatgggctaaatgtttgtaactccccttaagcaggaggattctgtagctgggtctttctgcctggtttgtttcaaaattggcctgtggaatttctaagcaagaacagaattaggtaagtgagtactgttcacgaatgtacctggtggaaaagggagaaacaaagagcttcaaaatatgtttcaaggctgaaagcaagataggaaaaaattggcttttgggactacttgggataattggttacagagttacacttagaaaactaaagaatagaatctccaaataaaaccaaataagaaccagagaagtaccttaaaaagattaatgtctattaggcaagtaaatcctagtctggggcttaatctgaaagagatcttaatgggtctgagcacatgtatttctgggaatagccatagcagaattgcttgtgagtttgatgcagtggaaacgccttaaatgtctaataggaaattaaaaaataaagtatgacgcagctacaaaatagaatattatacagtcaataaaaacgatgatgggtcatttgttcttaataatttttggttcatagacaccccccctcttttagagacagggtcttgctctgtcactcatgctggaatatagtagtgcaatcatagctcactgaaacctcgaattcctgggcttaagagatcttcccacctcagcctcaccagtagctaggactacaggtgcacaccaccatgcccagctaattaaactttttttgtcatagagatgaggtctggctatactttctaggctggtctcaaacttcaggtctcaagtgatcctactgcctcgtgcttacaaagttttgggattacaggcatgagccactgcacccggccacatagaaccttttaaggcttcaagagccatagaacttgtccccagaaaaagttatgcacatacacataaatgtcagcttacaatttcagaaggtccttcaatttacctgaagccaatccatgagacactacgctaagaatacccatgtaagatatatttttaatgacttggacaggtgtttgtgacaacataatttttccacaaaaatacagtttacaaaatggcatgtatgggatgatagaatttgattaaaaatgtaaatatctttctatctatgcagaaaatgaatctggaagaatgtcaaaatgccagtagtgttatctttaagggtgagatttttggatgatatttattttcttcttaagctctatttgtattttataggttctataataattgtgcattaatttgtacaataattttaaatagtcaattttaaaaatctgagaaacagttgaaaaaagttggcagttgtgaaagtagggtgtacaggacagctcagagctgtgaggactctggaggaagccaggtgcagggcaggtgtacccaagggccctatagggtacacctgtggaggtaggtctagaggtctagctcgtcctgatctgagctaccctgtctctgctccagtaggggaatgaaatcttgaacaattagttaagcacaataatttatctctttgaggtatggtccttggggctctgcagagctctctctggaacatgacattgaatcccacttatccgagtgagttaggaaatagaaacatatccaggtaaagaagacaaggatggagtccatgctacataaagaccagtggaaggtactaagggctggccagagaagagatgactacagatgggcaaggtcattgtttttgtgtgtttgaggactgtcttggagaagaggggatacagtcgttgtgtaacaatccaaaccagtgtatcttaggcactgtattttaggctgtgttctgagagctggagaaataggtgatgcagttcttctgcaacagaggatttaaggaagcattccaatgtggtctagtgtgggctataatgaagatttggaggaggagctctaggaaaacaaaggggcaagtgaactactctgcctggggaagttgcagtacattttatggtataacagaatttttctagttttagaaaggtgacaaagaattctaggcagggcagaaacagcaacgtatacaaaagtgagaggcatgaaaaggaggttacaaagggcagaagatgcaaacaaggctggagatttggtggtctccaaagtgtaaagagtcttgaattccatgttaaaacatttggacctatgctatggacatattctatagaaagtatccatcttgtgatggaactaggtccaatgatagaagatacagcaattgccttgggagataatgactgtccatcaaacagaggccagtaagccctttgatgggtatagactgaagagaaacaaccacataacagggcatttgtctggactttgtgatctcacccaccctctgggaaatgtcccagacttagcttttcaggaggtatatttgtgtatttccctctgcgaaagacagagcctggaggtactatatatttttgctttctaagttagagaactttttaatatcttgacagcttataccagaattcatctgtgaagtgtatctaagtctgcttgggctgttgtcacagaatatcacagactggtagctcataaacaacgaacagtgatttctcacagttttggaggctaagaagcccaggatcaagttgctggaagatttggtgtctggtgagggcctgcttcctcattcatggactgctgtcttctcactgcatcctcacatggtggatgtagcaagggagttcactggggtctcttttataaggacactactctcatgcatgagggttctaccctaacgatctaataatcaccttctaaaggccctacatgcaaatactatcacactgcagatttgggttcaacatatgaatttggggagggggcactaacatctactgacattaggatgtagtagaaggagtccttcttatttgaaagatcatatgtgaagcctctctgagtagcaggtaagaccccaaaggggttgtcaggagttcaagcaaaaggaaagctatagctaagctgtccaacctgagaatataagaggagttaagagatatatggggaataggagaggtcagtggtttacaaggggatgagagaaggagggactagaaagatggtctatggctgaggactccacagggtaaacagaggtagagctttacaacaatatgcattgttgtgcaagttgcctttgctcaactggttggctgaggcagctggctgggtttgcaattaaaccagtgtcctgatccctaagtcgtattttctgggtctgcacttgaaggaggtgtccctatggcctagtagtgaccctgggaagagcatcttatggaattgccttatgataaggtggttgttatggattgaatatttgtgtccacctcaaattcacatattgaaatactaattcccaatgtgatggtatttggtggcgggacctttgaggggtagagaaggttagatgaggtcatgaagatggggcccttatgatgggatgagtgcccttataaaataaggagggaacacaagatctctgtctgtctctgcatgtgaagatacaatgagaaagtagctgtctgcaaaccaggaagagtgtcctcatcagataccagctttgctggtaccttgattttggacttcctagcttccataactgtaagaaaatgagtgtttgctgtttatgccatccagtctatagtaatttgctatggcagcccaaactaagacagtggccaaaggagggcttcacaagggggatgcctaatgtccaatttgaagttgttgtgatataataatcctttttctagctactaaataaatcttcaagtaagtgcactatacttattagctctttgtgcaagatgagtgtatgggtgtgtagaaattgaagaaaggcggggtttctcgtctggattgtagccatgtggacaaaacagcatttgcagaatcagaaacctagatttggagacatcagaatacaaatcccccatgctcccgtctcccctttttctttcccagaaatctgcaggctttggtcttccatgaagcatggagttgatcgtttgagccagccttatctggattttaaagggcagggaggtagcaagtgacatcaggattacattttattgttttagtgcctccagcgagatgtcatgaataagtttattttatgactgtgtgtctctcgcttaagtaagctaatattgcatcatgggtagtttacacaaatcattgttttaaggatgcagttcaaaacaaaaatatatgagcaaactgaaattcttatctctaagatccaaaggataatagttcatttatgcatcacatcttctggaatgtatttttatagactgtaaattggataagatagctgagtgcaatgcatggtagggaaggataaataataagaagctttaggttcaagacccagctcatgctaagttgctgtgtgaatttaggtaattgtagtcctctctgatatataattatcctgtaatgttggagtgttgaacaaaaacgacctccaggatctgtattaattaagactaaattagttgtattaaaggaagatggaaacgtccttcttcctcatgtagaggtctcaagataggctataggtgtctctactccaagaaatcctccagggtccaggatcctttatatttttcctaaagcaggaaaacatacaaagccaagcaaaatatctaatgattaaatatgtaacctggaagctgcacatagtacttcagctcacattcccttggccttaagtttgtcacatgggctcacccaatctgcaaggtagattaggaaatacagaaatagagtctatattcttagctgatatacgttgccagctaaaaactggggttccgtgattccgagagaagaggataatgggtattgtagaacaattagaagtttctgccacaggttccttccagaactaacagtttaagattctaggtgttgtcaacagttttgatgatcagatatcaaattactctccatctttagggccctttctgctggatgatggttgagatgacttgatcacagaattagcaagtagtttagaccagtgctgtccaatagaaacataatataagccacacagaaattaaaaaaaaaaattctagtagccacagtaaataaaggaaaaaggagcagctaaaatgaattttaacaattaattttatttcatctaatcatgtaaacactattaacaagttattttacatttattttttcatactgagtccttgaagtttattttgtagtgtacattacagcacatctcaacttgaactagctgcattttcagtgttcagtaactccacatgtctagtgaccaccctgtaagacagtaaatttgtagactgtgttggctagaatgatagcaacacagtgtacaccataaatttttctattataaagggaatccactagttaattaatttagatttaactccatattataatattcattaatatgaaagagagcatcatcttttcacctgaggcttttctatgaataagttaactatggactattcgctttctggatcatcagatccagctagtcaagtcagatcatctatccaactagtcaaattggatagaagctgttggagtccagctctgccacttaccagctctgtcatcagaagtaagctgcctaactcttctgagcccaattttctttatctatgaaaatgtcacatgttaaagtattttttatctgtattttttggaagctggactcagcagaaatagcactggataaagaataaagaatttggattttaggttcaactttcccctggttctgtgaaactagcagcatcttctctttagatcttactttttccattttgaaaggtggggtggtatgttaggtgcttatcaattcctcttccctcttttcaaatggaatcatttgacgttatactaaaaggttcagatttctaggatatcattagggaggtaattgctttctcaactttcaactactcttaataattccataaaagggagaattggaatctggaaggctgaggcagccatagtagcacaatatttctgaattgatgcattctttggaagaaagagtgggaaggatcaggtagaaaaatcttttatggtagtgactggtcccttagcataaacattgaaaaaaaaatcccaaggaccctctatcaattctgttggaaatgtatattggggagtctttctgaaaacggatttggcaacatatatcaaaagatagaaaacatatatgtcctttcatgtaacgattttatgtctaagaatttaaggaaacaacctgatgttcacaaagatgtattgataagtgttcattgctctacggctgacaacatcagaaaatcagaaacactctgcctgcaaaaaataaggacttagttaaaaagttatggtacaggcatacatgaagatattattaaaccattaaaagccatgttttcaaaaaatatttaatgatgtaggcaaatgctttactacagtattgaccataaaacatcactaataatatgatgtactcagtcatatggtcggtcccagacttctttttaagttggccccttcccagggggtcccctcatggttcctaactttatttcttgccctctggtccctgtttctcctttccctcttcaaatgtcctcggagtgaaacttcattttcttacaggtcagagtctcttaccttgatttttttgatattttagcctggataattctatgttgcaggggtggtggtctgtcctgtgctatgtaagatgttgaacagcactcctaagctatgtgaattagatgtcagaagcaccttttcccggtgaagataaccaaaaatgtccccagacattgccaaatgttttcttggggctcagtcactcctccacgctgctactgagtttggtggttgtttaaatttggtgatcagggactaggaaccaaggtccaatatgactttaccatttgttccagaaaattcttgcccaggaagataaagctgtaaaccagtaaataacttcattgttaacctcaggcacttcatgaaaacccatttattctgcccaggccaattggatgctcatctgggtagacatcatctctcttaagacaacaggttgcccagctggaaaaaccctcttgctttatcaaacatccatttacttaggaagactacctccaagcctctagcctctcagtgtccaccaatcctaagatatcagatgacaaaacctgcctgcaacactggaatccagacccccaaaccctggacctcctctttctaagacaaactaaaacttgttcaaggcagtactctcccatatttggtcagtaaaaactggtctttgctgataaacagtggtctatctggggaattggcagtcccccagagcctttcccctttatttatttatttatttatttttttttttgagatggagtcttgctcttgtcactcaggctggagtgcaatggcatgatctcggctcactgcaacctccgcctcccgggttcaagcaattctcctgcctcagcctcccaagtaactgggattacaggcgcccgccaccaagcccagctaaattttgtatttttagtagagacagggtttcaccatgctagccaggctggtcttgaacttctgaccttgagatctgcctgcctccacttcccaaagtgctgggattgcaggcgtgagctaccgcgcccaacagcctttccacttttaaagaagggaacacaattataaagccctcaacccatgatgcccacaaaaaccaggaagaaattttgaaacagccacttttctgcatctaaggccacataagattcctaggcatggtgtccccacactgcactccataagtagaaaggaagccgcatgaggatttgtgttcctcctgcccacggagtgtgagcatgtgtggaagagggttaggaccacaagcttcataagcacaggaagaagaaaagcacagaaacacacccacgcaaatacacacatacatacatatataaacatagatatatacacacatacacataaggtggaattatgggtgatttcatttttatatttttccatatttaaaattttttcttaatgaacacgtcttcctgttaataattactcttctaatcttagatgaaataatatgttaatataatcctatcttggaatatatcgggaggtccagtatattggctttgaggaagtgccaaagaggtggaaggctgagtccttgggatcttccttttttctacacggctcgggagactggtagcaaactccgctacagagttgggagtgtatcatttgtaccaagtgttaatttgaagtgtgaaaggaaaagattataattacctgtccttttaaacttatgttttctttaataatctcatggttactaagaaatacactcagcagtgagatgggatggataagctaaggtgtatatgacaggaaacgatgtccaggcagcaaaattagtcgtgcagttgtatgctcacaggcatcgatggatgtctaagctgagtaagtccttgatacaataggtcagtttagtgatgaaccctctgggtttcaccttgacactaccacatgctaattttgtgaccatgagcaaaatgcatcaccttttgactgcagtttcttcacctgcaaaggtaagagacttgtacctgctcagtgaaccccatgagtttgttacaaagaccaaaagagatgatccatatatacatgcttaggaagtagttcaaatgcatggctttatgggaatacctctcaatttttcaagcacctctctgatattaacatagattatgataaacagcccacatccaatttaaatgctggggctgttaagctctatggagtgcttgaggcagaggtgtaggtatttggggatctccaccttatcttggggcaccctgccctggcatggcaccagagacctggctacaggcccctagcttacagcctggttcccccagggctgagtgcaatacctaggaggaatgtttaggaatgcctgccacagctgcccaccatctcttattaacatttcatgcctagcgtgtaaaactcaaattgaattttccagggtggagtcaaggaattaaaggaatgaggagcagcagatagacagataagcacatctcatgcttccatccattatttatttattgggtgcacaccattttctagtaaatattatctcgtttactagatgttatctcatttactaatactcagagaaacacaagtgaaggtctatgtgattgtagccatttacaagctccatgaatgtgacctaggtcacagagctcatcaatagcagagcaagaattcacacccaactgtgtaaattccatactgccttaccctatctatctgacatttgggatttgtatattcgccacagtggagtagcacaacattaagtagtagattttctactctattctttatatcaactacaggtggccagagggcagaggacaaaggaggcaaaaagaaatgggaatgttaatatttagtggtcttattcgttccccccaagcagagtaaatttatgcttgactatgcaaagtgcttaactatgcaaaacatcatggaagtgagtgacattaatatcaattacttcccagggattaatgctttctgttggttttctctgcaactatccacattttgtttccccacaatgtcataaaacagtgttaacttaagaatgcatgcataccatttcacaaaagtaagcaaacattacctgtactccttatataagttggtccctctctgggtatacccccttgctttgtgtacccctgcctggtctcccgaagtgacagctctaatgcaataatacatgattctgtcttgggctccttttgccccactgcaagcatcacctacatttatgtaactcgaggagcccacagaagtgttttttttctaggtgatgtctttttttttatatgtatatatctaaatagaagaatggctaacttaaattttaaatttatctcaacagataacctgtttgatgtcttgacaggcaccctactatgaatatattatatgtcatcatggggaaaaaaaaaaaggttggggtttgaagccagagcaacttggactttgaagtctgggttgtagtcatcacttgtgaccaggccattgttctctcagacaaggatgtgtctctccttgcctcctgtttcaccttcacttacctaacctccacactgcagccagagtgatttgtctaaatcatccctctgtgtaacaggctttaaagtattccccttttgtatattccaagttttctggatttgtcaccggtgagcagtgactatctgggctggtggcatgggggtaaaagaatttaccaagacagctgtagatgaagaaaggcagatttattaaagaaaatatgaaaataagttgcgagtttgcaacaggcagctggtaagagaggagccgactgcaagaaaacaaaggcttgctggggattttataaaatggtgttcatgctgtatgctgaggagggctttgtgcagtgctgataacgccaaggttgcagtgagctaacttgcaggtgtctggtgataagttaggtgcaggagggctatatgtgctggaccatggagagaggtggacttatagctgatctgctttcttcttttttctttcccctggtcccaccagcctgacttcctttccctaattaggactccacagtattgaccatgcatttcttttacatttataaaaaggctaagcatgagaatggataagtaaaatgtgagggtacaccttacagcagttaagatgaatgaagtatgtctttatatgcagtagtgaaggtacatctccaaatcattgcaaggactgagaagagcatgttgcaggtgggttactaatattcaatatatgttcagttttgggcatacaaaagagtaaaataagactccaggtttaaaaggtccagtagatagtattccctttacttgccagagttcaaaaccatctcactccggggtcctctggtctaactctctgtgtactctcttaaagggcccttaatgtggattgaggtgaaaaaagggcatcccctcctatgatgggatgaggatgaggaaaagcagagcaccccagaaaattctttcttttaaaagagaaagccaggctggatgtgctggctcacgcctgtaatcccggcactttgggaagctgaggcgggtgggtcacttgaggtcaggagttcaagaccagcctggccaacatggcaaaaccctgtctctactaaaaatacaaaaattagccggtacaggtggtgcaggcacctgtagtcccagctcctccgagtctgaggcaagggaatcacttgaacccgggaggtggaggttgcagtgagccgagatcacgccactgcactccagactgggcaacagagggagactccgtctcaaataaataaataaataaagccaaacatacataggcacgatggtagacttagttgtcatccattttgccatgtgcttgtcactgtgtctcaggtctcttgtctctttattctctggaagaattaattgtaagccatttcataaagcttttagatgggtgatggggttatgttgaccactcatcctcatgtctaccacaggatttctgtgcttcagaatatccagtatttgataggtactgctttgtaagtggtctttagggttttttttggcacaaactcccaggtggtaggagatgtgaacatggttttacacttcattaagcccccaggtaggcaatgatcaggccccactatcattcatccagagcatgggtctctggtgcttagccctgcactgggcactaagacattcacaaagccaggcttccggctttggggttttcatcaatggtttaaattaccttcctagtcagctctctgcaactgtcccttatgaaaaagctaagcctcagtcacagggtgactcaccaggattacaccacgtatttccccactttgaggcctttgctacctatgtccctctgcttgtggtgacctttcttccaccaatgaacacatactcaccccgaaggccagaacgcctttgctgattcccattgcacctctcccatcttgaccatcaaatccttcctctgtgcactgctaacccttctccaaggttgccaggtattggatgttgctgggcgcatgtctgactctcccagtagactgggagttcagtgagggcagaggccttggcttttttcatttacgtattttctgagatgcagtgactatcacatgctggaagggatgacacttgagtccgccattgtgccatgagcatacttggctcttggtacctataattgccgttcccctgctccttcttggggtcctctcttatcaaagagagctcaattcatttctggatcctagagggttctcaggaagagtgactatgtagatgtggtggaaagagaaccagctaaagaggcctgggtttgcctctctcctctctcagcttcctgggcatgagcaagccacttttccctctctgggcctcagtctctgcctctcagtggggactgccactcccagctctgaacatgtaagaatcagttgctgtttactgtgcttctttcaagtcaacctcccctgtctttctgtctctgtctctctctttcccctctgtccttcctcttaggtgcatcataaaccaagagtttacagtaaaagcacaggaagagctgagtgatgtgttctcttcaggaaagtacctggtcccccagggagctgggggcgcctccagagcccctgcctcccgagctgtggctcctgaggactttcagtgtagacctggcaacccaaccttagcctttgatgtggctctgacagtgctcaatgcacaagcagctcaaattcagaaccgtggaaaggcttgttgctttctgtcactgaccctggagactgatcagaggttagggtgatggggggacagcctgggggtctctcaggggagtggcacagagcatgaatcttgataatcacacacacatgatccccagacttcaggtaggaccagcttcttctttcactcaatctctcctaaagaggaaaccagacctgcccttgtaatctttgtgcatcctgagaagccatgcgatgcccagaggaagtccctgaagggccatcatattgaacaatcagcccttgaatcttcaagggtgtctgtgttcttataaaaaactgagaaatcctaaatttgtttgttcacatcttgtttttcttggtagaaatgatggaggattctgaagatgtggtttcaactcatggctttcattcattcattcattcattttcttggcaaacattggaggacctatgttatgcaaggcactgtgctgggcatcaggaatacaaaggctttatataggtaggttggtagatagacagggatagatagatagatcagtggagacggagatatggatctagttttagatctatatctatatcttgcaaggcttagagtctggtagtagatgcaggcatcatacaaatagtgacacaaataactgtggtaacttgccagagggaaaatgatggtgagccatgaacctataaaatgaaggaatcctgatttatcctgggaattaggcaaggtttcctgcatagggccatttgagctgagtatcaatggaaggagacccccaaacctcctgctaccaacactcatcaaactaattgtaatgtgggtcctggaattaggctgcttgagtttcagtgtctctactaaaaagtaaataattttacaaagtcattgaggacttagtctccctccttttacaaagtcatccaaccccaaccctagagtatatccttcagcctcaggtcataagatgggtgctgctcctccagccatcacaattattttccggtgcaaagaagggcaggaccaaaagccagaggggacatttcgtttcagagaagttaaccatgacctctactcattgaatattacctacaactcaccgggcagaactggatcttacaactacttctattttcaaggatgttggcgtgtgcacgtgcatgttttgtgtgcgtgtgtgtgtgtgtgtgtgtgcagggttggtaggaggaattttaaatcgagtattttgcctttttgaaccaaatcagaggagactgggtggaaaccagctctgtctgccaaggctctagttgacatttatttccttcatttccttttcatcacctttatctttttcctgctcttggcaacaccgactgaaattacttttgggaaatgaacgtgctcccagatggaaattcctgatggtttaccttctcaaacccaaagaatgaaccttcaggattttgaatcctaagcagaagagacaaagctagcaaaacagtgggagtacattcatttcaaggaatggtcagaattatgccttcattttctgcttcttagaaccctggaactgcttgattcctgttcttttcagacgcagactctgtgttttttgtttgtttgtttgtttttttgtttttgtttttttggtttttttttttttgagctttctttcagatccaaggagctgaagcctctgctccctcttcctagatgcctccagtcagaagtaccttctttacccctgagcacccagctcttcactcaaagctcaacctggtgctcaggtcggttggcttttcccttttccgtggtcgcctatgagtctgtccccccgtcccacccccatctagtagactgtaagatccttgaaagcagaggctgggtctaattcattttaaagtctctagcaactagtatggtgattagcacatgtggtttctaaatacatgtttattgttgttggttttggcaggcccagcagggtgctggcactattataagacagaaaagcagaagcgggtcttggccgtggaggggctcctgaccatgtctctagacctcttagaatcctactagctgatggagttagtgacttcttatttttcaggaagttttgactcctggagccacctttccctctatattacaacaaatgctgctgctgcgttcttcttcttcttcttcctcctcctcctcctcccccccttcctcctcttctcctctcctcttcttcctctgcctcttcttttttattttctctctttttttttttttgagatggagtttcactcttgttgcccaggctggagtgcaatgatgtgatctcggctcactgcgacttccatccgcctcccaggttcaagtgattctcctgcctcagcctcctgagtagctgggattacagggatgtgccactatgcccagctaattttgtatttttagtagagatggggtttctctatgttggtcagcctggtctcaaactcccgacctcaggtgatcggcccgcctcggcctcccaaaatgctggaattacaggcgtgagccactgcgcctggcctttttcttttcattatcctctttctaccccctcctcttcctttgctgttataatcttcatcatcaccactgttaacccataccaaataccgtgcttactatgtgtcaggaatgttcaaaggattactgaagagggtaagccccttgcccaagattacagctaatttatggcagggtttggactcaaactttagtaagtttggctcaaaatctgtgttcttgaccccccacccccttagtcacaggtactgacagggaactctggggaggatggagaacctctctggccatgtccacctctgcttgaactccttccatggtctgcagtgcccactgtggtgtgcacaactgctggcctgatggctcctgctttcctccatatgcagcgagctgcctttcatgccgtttgttttctgttcaacttcacatgccccaggttctaacagaatcaacctgctggtcacaccagcatgctctgtgcttgcctggccggatgcctttacaacgcattctgtccacctgaaactctcttccccaacccgcctggggaaattgtacccttcatttaagacctatgtcaatgacggaggtacatgaaatcctcccggattcaggcccacctccccattttcaaaccttagctctctcttctctaaagctccatggcacttctgattttctttttgtggtctcaggaagccatgcagggaagggactaaggctttacagacccatgcactctgctaaaatccctcttcaaccccttgctagctttgtgaatgttggcaagttacttagcctttctaagtctcttacgagctgtgaaaaggacatactttgggaatatgagatgattctaataggatggctcatacctctgccctgaccctgacactgtttttcttacatctgccacccaccatttttctgaggcaaagatgctaggcagcccacaggcctgactttctatcctgtatctgccagggaacagatcatcttcagtgataagaacattggaaaatgacacccttggctgtatcgcttctgtctcatctgctagggtgcttattgccctgacagcaatttcctatgtcccattccctctgtagctggtgggcagcaccctagatatgaatatctgctccattgaggataggaattctatttcaatggctttgctactggtttttttattggtaggtccacaaaccttgcgtggagtgggagggatgaatgtatgtgtggaagaaaaacaacctagtcctagttacggaattggctttaactcactgtgagatcccatcaagtctctgcccctctgtagcctcagtttctcatctatataatgggttgctgtgactcaatccgtaagcagcttccacctggatcaacttattagggtctatgagtttgtttcaggggagtcagcttggcttctgatgccctgtggtgttggaggaggggtggttgttggtggcaggtcagcctgaactatacgagtctgcaatgtgtgtgtgggtagtggtagaggagaattggactgatgcaggtttctgacaaggggatatgtgatggctatcttgagacagtcactgagaattcattactacttggaattcttgaagacattgcgggcagcctctgtacattttcttaaaggcatgtaattagcgttcactgagtatctgttgtatactcatatggttgttaggagctttacgtttgtatttatatttttcacatggatagttggtttactcacatactttatgtcagggcacagcatcatcattggtacaaataacatctcttgatttatttttattttattaatattattttcttccccatacccttgatcacctttcctaccctcttcgagcccatcctaaggatatgcatattttttaaaatgtgcagtgtttatggtggatgtatcatgtcttaatgtacatatatgatggtgtgatatagatcttattcagtttcttattccttcacttaacattttaagactctgtccacatcaatggatacacttttatctgacatttctaactggtacataatatctctcagtgtgcagccactaccttgcatgctttccttctcctgggaatggtgtgtacattgcctccagctcccagtgatcagaagcagagatgcagaactgctctgtgtatgtcctacatgaacttcttccttcctcctactcttctttaaagacagccacttgctactaacagagatagtttcaggtgctacatagtgtggctattagtaacatggaaatatattctatttgcactgtggagatcctatcagttctatattagtaagttatgactacctctctttgcttgctaaagttcccttttttaatagatcagaaacaggcctcaggctaaattattttcaggcagcacactttagctgaaatttaatcatgttggaaatctaattaaaatgtaatttaacaaatgtatttatttaaatggtttcttttattttaataagcaaagctgattttttatttaaagaagtgacacttcatattcaatagaatctaaaatgccactgattataaaaatcactattatatattccattaggaaagaagaattattctattaattaaaccatcatataccattgcttgtaagaagcatgctgttttcagagaggttaaaatgtgtataaatgtacatctgtttctgttttctttgacaaaaaaggttatttaagtaaaaagaaaaagattggcttaatacaaaatagtaataaatgacactttgggcattaattgaatttggcaggaatgatgacactggcagaggaatgtctggagtctgagaaaggacattatgtcctggggatgatcatctcatcagccacgtaagggaggtattgttatttctgtttaacaggcaagaaaaacctggggcagagagaagtggccttctcaaggccacaaggttaacaggaaatttaaactcaggcagggaggtcagaaggcccacttctaggtaccaaattccgtaagccttgtgacccgattccagcgtggcctgtctcctgcaccttctctctgagaggcgctgacaagtgctcaaaacctggcccgtttccctttaatcccgagcccttcaaagcacctgaaccctcccatgttggcaacctcttatcactcccactcaagtgtgacttagtgtgtttgtgttcgggtacctttctcacagtggctatattattatcaaatggggaagtcaaaggatgatgaatggacgtttctccactgtggactgcactaagggattgcgacagagaatagtaatagttgtagtgatttctttgttagttacaatctcttccttttttttcttcttttttttttttcaagaggttccttctgtcacccaggctagagcacagtggcacaatctcagttcactgcaacctctgacttccgggctcaagtgagtcttgtgccacagcctcctgagtagctgggattgcaggcatgtgccaccacacctggctaatttttgtatttctaatagagacagggttttgccatgttggccaggccggtcttgagctcctgctcctggcctcaagtgatccacctgcctcagcctcccaaagcactggaactacaggtgcgagccactgtacacagccagttacacactctttcacttatatttttatttgatctttatcacgtttatgtgagtaggcattatccacatttcacagatgtaaaaattgacaatactaacttgccccaaatcacacagttactaattggtagagttgtaagtggagctatgaaggcattgcctcttgctttttcaaaaattaaacattttattcagagataattgtagattcacatgccgttgtaagaaatatatcagagagatctgagagagctggtgtagtactggctttaccagtttctccaagttgtaacatcttacaaatacagtacaatagcataaccaggtactggtattgatgcaaccaagatacagaacattttaatagatctattatctgatgttgcccttttattgccacctggcctctctctcctgaacccctcccaccctgactcctggcaacgatgaatctattcttcatttctagcattttgtcatttcaaatgtgttacataaatggaatcatacagtatgtaaccttttgagattggccttttctcactcagcttaattctctggagattgatgcaaggttcgcccctttttcttgctaagtactattccctggtatgaataaatcacagtttgtttatccagctacctgttgaaggacttctggtttgtttctagtttttggctatcatgaataaagctgctgtgaacaatcatggacaggtttttgtgtgaatataacttttcatttctctgggatgaatgcctaagggtacaattactgggttgtatggcagtccatattttgttttataagaaacttccagactgtttccagaatggccatactattttacacctccaccagcagtcatgagtgacacagttcctctgcaacctcaccaacatttgtttcctttcactactttttatgttagccattttgataggtgtgttgctagacctcactgtggtttgaatttacatttccctgatggctaatgatgttgagcatcttttcatgtgctgagttgtcatctatttatcttctctggtgaaatatagtcatgcaccgcctaacgatgtttccatcaatgacggaccacatacatgatggtcccacaagattacaatggagctgaaaaatttcttttccctagtgatatcttagccattgtaaccttgcagcagaatgcattacttatgtgtttgtggtgatgctggtataaacaaacccacttcactgccaactgtataaaaatattaggtatatatataacacttgatatgcgataattataataaacaactgtgttgctggttgatacatttactaacgttgttatcattattttagagtatactcctcttctcttaaaaaacgttaactgtaaaacagcctcaggcaggtccttcagaaggtattccagaatgaggcattgttatcataggagagacagcttcaggtatgttatcgcccctgaagaccttccagtgggacaaggtgtggaggcggaagacagtgatattaattatcctgaccctgtgtaggcctaacctaatgtgcgtatttgtatctagtttttaacaaaaagttttaaaagtaaaaaaataaaaaaaatagaaaaagcttacagaataaggatatagagaaatcaactatttttgtacaactgtacaatgtgtttgttttacactaagtattttacaaaagactcaaaaagttttaaaaaattacaaagtttataatgtgaaaatgttatagtaagttaaggttaacttaccgaagaaagaaaaaatttaaaaaataaatttagcatagcctaagtgtacagtgtttataaaatctgcagtaatgtacggtaatgtgctagacattcatgtttgctcacccctcattcaccaacagagcaactcctagtcctgcaagctccattcatggtaggcaccctattcaagtgtaccatttttaaatcttttatagtttatttttactgtactttttctatgcttagatacataagtacttaccgccgtgttacaatgatctacagtattcagctcagtaacatgctatacaggtttgtagcctaggagcaataggctataccatatagcctaggtttgtagtaggctgtatcatctaggttagtgtaagtgaactctatgatgtttgtacaacaacaaaattgcctaatgatggatttttcagaattgagtgtgatgcatgactgtacttttttcctctgaattcccttccatttttccccaacatcctttttttaaaatggaaatttttattgagataattataaattcacatgcaattatgagaaataatagagatcaataataagaagatgaataacctaattaaaaggtgggcaaagagttggaatagacatttttccaaagaaaatacacaaatggccaataagcacatgaaaagacgctcaacctcattagccatcagggaaatgcaaattaaaaccacaataagataccacttcacacccattaggaggtcataataaaaaaagactaataataacaaccgttgatgagaatatggagaaattggaatcctccttccaatgatgggtatgtaaaatgatgcagatgttttggaaaacagtctgatagtttgtcaaaaggttaattgtagagttagttaccatagattcagcaatttcattcctaagtatatactcaagacaactgaaaacatatgtccactcaaagacctgtacatgaatattcatagtaacattatccatagtagccaaaaatcggaaaaacccaaataatgtctgtcaaatgaggaataaataaatacaatggataataatttagtaataaaaaaatgaaatattgacacatgctacaataaatgttcagtaaaataagtcagttataaaggaccacataattttatgactcttcttatatgaaatttacacaataggcaaatctgcagagacagaaagtagattagcagtggcctatggcttgggaaatggtggggtcagaaagtaatggttaaggagtgaggggtttctttttgggataatgaaaattctctacaattgattggggtgatagacacaaaactctgtgaatacactaacagtcattgaattgtagaatttgaacgagtgaattgtatggtatttgaatcaataaaaaaacaaactgtttttaaaaatagaaataatacggaaaaaatctgtgtactccttgcccagtttcccccaatggtagtatcttgccaaactatagcacaataggaaattaagacaaggatattgagattgatgcaatccactggtctcatgtagatgtcccctgtttaactcgttctctttcctctgtctctctctttctgtgtttacttgtatacattttatcacaaatgtagatttgtggatccaccctcacagtcaagatactgaacagagtactgcctgttttaaagctctgttcactgtaggttctgtctgaagcagcactccagagacctttagtttttcctcactattaataatcagacgtgaggcagctcccccacttgcctccacagcttcccacccctcctcatcggggtcagaggcagaactcacagagaaacatgaattctcacccacacaggagggatgcaagtttgggatctcaggcaccattcatctagattctagagtcacccacacttaggaggaggaaagtatcttaccaaaggaaggaacgtgaattctggaagagggatacgcccccgtgtctccatacctcgctttttcctcccaccaatttcggaagtgatttctataactcccaggcccggtctgcaaattgtcagcgcttttggagatccggtatttattgggtcgccactagcaaacactctcagggaaaggactggcaatgaatcatctgtactaatccctgtgttttcatcagtcttgcttcggtgcaaggggacagccccggttgttcttctatatcatcatcactttggtttctctcaaaatgtttgctcagaaaaagcccagagtttggcctcggttcactttggacttccaggggaatttcccgtcctccttggactccatgggtgaagctgtttgaacattcgctccttactcagcagtgcagatggcaaagccggtgccagcacagatgtcttttgggatcaaagacaagcttagcagagtcacataattcgagacaagagatgtgggaaggagtagtagtcattactctccatctctcagctctgattccagtgaccccaaatcacctgtcccatcatagttgactacatgctaatccctacttcaccccctaactggatcttataattcagccaagatctggctgtctaaaacgtatctttgtgcacatgcaccccatatgaccttacctgtggcccctgaactctgaccacatcaccccttccaaaccttagaccccagacccatgatctcaattaaacttagcatcatgactggcacatggcaaaatatccaaaaataagtattaatgctagtgtttataattatacctctgattaactgagcactaattatacctctaattgtgcatcaggcagtatgccacctctttttaaaaaaattttatttttagttctggggtaaatgtgcaggatgtgcaggtttgttgcgtaggtaaacatgtgccatggtggtttgctgcacctatcaacccatcacctaggtattaagtccagcatgcattagatatttttcctaatgctcttcctccccccaccccaccccccgacaggccccagtgtgtgttgttccactccctgtgcccatgtgttctcattgttcagctcccacttatgaatgagaacatgcggtgtctggttttctgttcctatgttagtttgctgaggataatggcttccagctccatccatgtccctgcaaaggacatgatcttgttcctttttatggctgcagtagtattccatggtgtatatgtgccacatattctttagtctatcattgatgggcatttgggtagattctatgtctttgctattgtgaatagtgctgcaatgaacatacatatgtatgtaatttgtaatataatgatttatattcttttggatatatacccagtaatggaattgctgggtcaaatggtatttctcgttctagatctttggggaagccacctcttttataagcacattctcacaactgtgtgaaacaaatagaagctcagagatgaaaagatgtgtccaagataacataatgtaatggtgataaaaattgtaataataaattataatttctctcttttagtcatagtttcctggcaacctcctacctccttcaaattcattattccagagaacaggtacttgacctccttagtaaaaccatatccttgcaaactggttcttatagagaagaaaataatttgctgaattcatgtatctctcatttgtcatatcaaatactaagcacagaagactcctcaacatttacctctgtataccattaaggctcagcatgaggttggctcaagtggtattagtcagggttctctagagaaacagaaccaatgggagatatatatatgaatgaaacagaatgcattgaatattcagagaatattcagagagagagggagagagagagaaagagagggagatttgggtggaggagctgtttaataactggcttgcatgattatgaaggctggcaaatcccaaatctgcaaggtgggccagcccactagagacccagagaagagttgatggtgtacctccagtctggaggccatttgctggcagaattcctacttcctcaagagaaggcaatctttttcttaaggccttcaactgattggatcacccacattatgtagggtcatctgctttactcaaaaatctactgatttaatgtcaatcttatctataaaatagcttcacggcaacatccagacatgtttgaccaaatatctgggtactgtggcctagttacgttgacacataaaattagccatcacagcagcctaggattttatggaaaggagaaggcagagcaggaggaaagagagaggatggaaccgtcccgtattctagtttgtaactgcctgggcacttgaacaacaaaagagaagtgcttaagataaatgaagcaggtatccagaacagagggtggttcttgcttctactctgcttggggagctgccaggaaaagccacttcacaggacgctgcagtaatatcaggcagctcccccagagaacatggcggtgtagtgtctgccaatccaagaaagtctcagcagtttagctttctcaaactgttcttggttcctgtgtgccatggacaagacctagaagcagctgagagcttctagggagtatgatgctcattagagggtctcaccatagcagggccaaagtggctctgtagtgaaggctgcacagacaacaaaccatctgacctgaggctgaatggatccatggaaagtccccagaaaggtctggaagtagtgtggctgagttagccagggagcacctggactttgcccaaaaagagacagcagactccaagtttcatctgccaaagacttcggttgcaaacacgcaaacactagcagggcagatgcaaataggtcaacagtgttccttctgacaccagcattcaacaggctctgtgactcagggctccaacacacagaaggcaccaaggagaggagctggtgacggccggaagaaaaaccataaagattggacttttttttttttttttctagagagactaaaaagttcctaaagggactatttaaaattattggctcaaactaagaataaactacacagaattcatttttttatttttgtcacaaaatttttatttttgagacaggatctcactctttcacccaggctggagtgcaatgcgttatcgcagctcactacaagccttgatctgttgggctcaagtgatcctcctgcctcagcctcccaagtagctgggactacagatgcatgccaccaagtccagttattttatatttttttattttcagtagagaggaggtcttgcccaggctgctctcaaactcctgggcttgagcaatccttccgacttggactcccaaagtgctgggattataggcgtgagccatcgcacctggccaaaccgtatagaatttaaagtctacactttatctgctaactgaaatgaagacttagattcattagacaaagcaatatatatcagagttgaagtgtgggtacacttgtgaacttgtcgcagtggtaagtggtaaatacagaagtttgaaaatcaggtctgtgtaacttcaaactgtgctgtctcctgtacagtgtcattgcggtgaactgacagtccccaagagccttcatcaccactggctaacctgcctcgatcctgttctctagccagggccttctgaggtttccttaaggtcaacttaggctaacaggtgaaggacactttcacttctttgtatgacccactgctatactttctaacttttattttgagaaacttataaaaaatacagaagagcattcataatacgatcaatcacacatattgccactatccaaattaacaaatgttaggatcttatcatatttccttctagccttatcgtattttcttctgatgtttaaaaacatcaggaaaacattgcagatgaaaatactgtttcctttgactatgatccctggactcattttccttctacctttcccagaaacaaccaggttcataatttgatgtggattctagtccattaaaaatatatagctttttgcacacaaatcacactaatgcatgcatctatgaaaaatacaaaacattttgtgtgtttcaaatttaattaaatggtatccaactgtatataatttgatcactgcattttcacttaatcttagctttaaagactacatgttaatgattctagttattcatctgctacattttatttgctctccttttgatggacatttgatttttttcaattgcttataatttatagctggaattcttgtggacatctctgtatatgtttctatgaacatctgtatgtgtctacctttggtatgcttctggaatgggaaagcctggctttctcatactcgtatgaggtagttatcacactaggagctcaataatttgtgtgtgcccctgtctgtccacctagacactgagttccttgagatcaggggccatgttttattcatctctgtattaccagtgtctgacatatgattttgaagtaaatgaataaacacaagcaaaaatgagatgcctgcatccctccctctgtttcacaaaatagattcatcctcaccctggcatgatgagagtaaagggaattcccttctgcaacttaccatgtgcattactcacaggattgcatttaatgaccacaagtttctgagatgtaccactttacaagtgatgaaactgaggcttagaaaggtgaaacatttgggaagctgaggcagacagatcactcgaggtcaggaggtcgagacaagcctggccaacatgttgaaaccttgtctctactaaaaataccaaaaaaaaaaaaaaaaaaaattaagcgggcatggtggtgtgcgcctgtagttccagctactcaggaggctgagccaggagaatcacttgaacccaggaggcagaggttgcagtgagccaagatcatgccactgcactccagcctaggtgacagagtaagacacggccagtaaggagtaagggtgagaaatgaacccagacctgcccaaatccagcacctatggcctctccattctcatttgctccctctcaaaccatcggacgtgtgctgtggaaacattctgatcttttgccttcataaacatgacatcagcttgaacaattctctccccttcgatataatttttttcccctcagagtctggggaaattaccttcattaattatcccacagctttgactaattaactcacatccttctctcttgtgctttgaatctacgtgttagaatcctaaaatgttagcaggatgctttggtataagtgaggccaacctcttcattttagagatggagtggatggcacatggataaggagacaaattgcattagaagctgagtcagccccgggtctcctgggactgggtctggtgccctgtgatcagtcttttagattatctgatggaagtggctctcctccgacagggaggagaactaggtaatgtatgggtttgccttctcactgatattcagagtaatagagaagagactgaacaaggatcagggtccgggaaccaaggaacattctatcagtgaaatccagcttggaaagcactggatataatctccaaaggagattctgaatttgctggactaaagtcagaggagaaagcaggcttgactgcagaaggaatatattagtcagggcaggcttactgctgtagcaaacagctccataagctcaatggcgtaccactataaaaatgtattgtttgctcattgcttctgttgtgtttgatctctgctctgtgcagttgttcaggagtgctctttccatctttggactcttccctctccaacacccagtacataaagtcagcaccagcgggtataggaagcccatggttagtccaggcgagtctggggcagagcttagactagagcaggcattcctggtttcatgtccagtgactggtatttctaccacaccgtcctgcctttcaacatctctgctcctcaggttgctcctctctgaagtgggaattatatagcctgctctgcccacccctagggttgtgagttcaggtgctagaattgtttttgtaaatgggtgcatactgtgcaaatataaggatggctgtggtttcttttttacatgacatgtagccaagcatcctgcttgcccctacctggggtcctttcccttacagctttgaaagtagaagacaaatttgagaaacattcctcataaatgggaagacagctgtaatgtgtcctgtcaggacttagtctgtggcacaggaaatatctcctttcaggcggtgccggtggacccatgtcgtgtgtgcactttgacactgagggtcagttcctacctttcccaggccctcccaccttcagccatcaagcttatatcttgggggtcagtcattgaccttgaaccttggctgcagcaccatcagaccctggcagggtagttggttgtcttgagcatggaatttggaatccagtaactctggattaaaccttcattctagtgtttagtggcctcactttcctcatctataaatggggagaataacttataaggtagttttgaagtctaagtgagctcattatgaaaactgcttagcagactgactgtaaatagacagcattcaggaaagttgcggttattttcatgccatatccaatgtgctagagatgagttctgggtgcttgcataatggttgagtcagacctgcatcttgtggcttccctgttggccctgtttctatgagcagccttctggctcagtgtccctttcctgccagtcccaattcctgccctgagccttagtcatcttagttgacgtctaaagactatgtagccctggtgaggccagaacctatgccgcctccagcactccccaaccctgtctgctggcttcccatggtaggctccatcacctgactgcctgggtacagaggactgaaatgtaaagcttttcctgaagctgttcactgtttggcccacatagacctaactgatttggtctcctatggatttcctggttctcactatgtaaccacagtgagcttctgcctcagctcgttaggcctaaagaagagcctgagacaagggcttgggaggtgcccccaggatataggggtgagggaccaggagtgagggtaagacagggagggaggaaaagccaatatgtgctatacttaattagttcctgctctgggcaaccgtggatccccatgaggccccttctgaattgtcctgtaggagcctgggacatttatccactggtcttctccctcactagctgacgttccactttgaaaatatttctggctcagatctgagtgggcttcccatactcttgagaaagccctaaggcagagaagtggagagccttagaggcacatgcttgcaggagaacctgaccactgcatcagctctgaaatcagagatgatatgaacacaaaaatgtcagcagaagccgttttactcagcaagctgcttcctcgccaggctttgtgcatgaactatgccacggaccacattgaaggtctaggatcatgttgccttttcagagaggtctttcttgacctcctatttgaaggtgcctacctgtggttactccatcccaagcaatttcattcctgtgacccttttctagcatcctagctagtgatgcttaaaatctaccagcccacatatgtatctaggtcttgggataggtttaaacaagacacacaccagacttgggctggggtcattatgtaaaaagaggaaccgggtgcggtggctcattcttgtaatcccagcactttgggaggccaaggtgggtggatcacctgaggtcaggagttcaagactagcctggccaacatggtgaaaccctgtctctactaaaaatccaaaaaaaattagccagatgtggtggcgggcccctgtaatcccaggtacgccggaggctgaggcaggagaattgcttgaacctgggaggcagaggttgcagtgagccgagattgcaccattgcactccagcctgggtgacagagcgaaactccatctcaaaaaaaaaaaaaaaaaagaaaagaaaaaagaggtataagatgccaatgccagtccagttagcaggtgtaaaaggagtgctaaagctttggttgattatcagatgttagagtagaagacgtcaagaggtgaggggagcaaatcatgagacgaccagacagctcagtgttatttgcagacaatgttgggctgataggaagctctcttgggaatggaaaagatgcatcttctggtcccggtttaggcctatgtaacagcgcttctctgtatggggttttgctccctcagtgtggccatggaaggataggagaagtgaccacttccttacacacctcaatgaagatatatgtccatctgcttgcagtttgtttccaaactctgaaggcagcgagattctcggacctggaaataggctcttctgagtcttgctgcaaagaaaaatggcttctgtagacacttcgtatgcagctttcagtggccctgggatttgggagactccagactggagaacagcagggtatgccttctgtggactagtttccaagctgctagtgagagagccttttctccatcaggccagctcagcaagacctactcggctgaatacagtgtgagtcactctccagactgtggtcaggagctgaggctgcaggtttccctttacagtgacctcataatccctgtctcaattcccccatgctgcagaaaaaaaaaaatctccattcttcaggagaagtctgcagaatgatgtgcctggcttgtaggcagagaagacattaggttgcttgtcctttcatcctgtaggtttgtttctccttcaagcagaattgcaacatgaaatgatctctcttctcagctttttttcttgctgcggtcaggttctgcagtttctgatggtggaatttccatgatagaaggaaaatgggatttactccttatcattactgtaggcatccagactgtgtgggctgactttttgcaccattaacagtgtattgattacgctcatagccatcttcacagctccaagataatggggttctaaatgaaagcgctccattttaatcctaattgtattaagtggtgcacgtcctcaatgatgtagttttaaaattaactaacctctctgtgtcacagtttccttctttgtataatggagattataatactacttgcctgatatgatttttgtgaggattaagtgagtttttacatgagaaacacttataaaagtgctggcatatgccagaaactgtgataagtgtttgatgttattatttttagcatcagcatgcatttaaagatggtgaatctgaggaaaagaagtcacatatctttttaaaagtggtaatctgtaagcaatttcatgtttttaatattcttctatagtacgtttttgcagaaggacttgcaatggtttatggattaaagagaaagcagtgttcaatcattgggaagaaaaagagaacagagaccagtggaagaaactagaacaaattatgccatagacataaatgtgatgattggaataagtggccaatgagttcgtccttacttaccctgcagctaaagaagctggttgacacatatttcatttcctgattacagcatcaaatacattcattttcagaaataaattctttgggggcttggtggggcagatgccgtaggaatctaccacgtggttcccttaagtataaatgactttgaatacattttattgtatctccttgtttagctttactatgaagagctgttaaagatgtgaacctctggaagatcaaggactttgccttatggaatgcaaataaccaaagtagaaatcatggtataaatgaaagacaaatacaagtgttggctgcagagtgctatctcatacttagcagggatgtacttaagtcttacatttgcttccttccctctgtcctcaaactcctccataaagcacttgatctatctgtctgctcttcctcctaaattaactgagagcatttgtattagttccacttgttaagcagccagtcaaatggttattgatcatttactttgtgtgaaggatgtctgtagagagtcaagggagatacaatttactgggcaccaattatatgccagacacagactgggacactttatatacaccactgcatttgttgcaatcatatgaaatagttattattatttctgatttacatatgacaaaatttgtatctcagagacattgtgtaatgtgagcaaagtcacatggctactttcatagcaaaaccaggacttcaaaccatccatcaattgattcattcattgattttgcatattgctatcatctttgccatgtactgctgatacaaaaaatgctaaggaatgattcctgcctccaacacaccctcaatctggtcaaagaggcaatttcctgactccatgcccagaagtcttaggtataacccaatctcaagccttggttttgaagacatgtgttacatgatatacatccagctatttaaatgtcaattgaatgcccttgggaattatgtgggaaaaaagaaaaggattcagtggtgactgaggctggaggctgaatgctattaaaacatcatatctctttttacactaaaggtctcctttacagggatgaagtctttgagcaagactcttgtaactttctaagtaaagtttagacagtctcacctaaaagtgaagttttgcctggagcaatctcttgcagaaattatcctgatccaggaggcagtgatattctcctgcaatgtaacatggccgaggctgcagatttcttttccagtaaggagcttgctttggagaaactaattaaacctggaatttttagaaggcttagggttttgtcaacttgcaattatggatccttaccagcatgttccctgagggaaggactctgcctgtgcaggggaacagtcagcacttctgtgtttattctcctttctgtctcccccaggagtcatcttcttaagaataacatctgtgttttgtgatgtcttgactctttcatgattgtccttccttttgtggcatttgaaactcaggctggagactgaaaacctggaatagaaacgttttttgacagctttcatgcaacaactaactcgacaagaggtaagcacactttagggctggagggaatattacaataccactttattgaatgtctgaaccacccccaagacctagagttcttccaatatcttccagtatcacttctataacagcttgtttgttctttggatggctttggttattcaaagttcttttcttattggagtgcagtttgttcccttacagatttcatcatcagattctagttcttctctgtcacacaatagagtatgtctgttctctcctctccatgacagatgtgcagagattttaagacagagactatgtccctgcttattattccattttttttctaaagaggtggagtttctggttgtctcactatcctggtggtctaaatatgcttcattctaaggatgataaatatattagtaagacacatctattaattgaatggaaacttctttcctggtagcctggtcgtgacctctgaatcctttccaataacctccaggcagctattataaatttatttcttaatatagagatcttaattgtgcaactactatgttcaagtgctatgcattggggatgcagcattggagatggagtgctgaacaccgcagcctgctctggagctaaccgagacttgcaaaagaaagatgagcactgagctgaaggctctttgatacctttgaatgtggctttttggtggagacacattttcaaatctgactctgatgctcacctgaagggtgtccaggtggagagtgatcctcagctcctgctgagctgggtctactgtgtctctttcccaaaccactttcacacccagaagatctgctctgccttgttctttgctggctactcagaaagccctggtggcagaaaaatacatgaaaagccgatgcctctggggataagcaaagcttcattttacactgggaaacagaggcctttattggagaagctgttgagagcataatcaagtgaatccagtgtagctacgctcctaccatacctgggaaattcccccttgctctctgcccccatcatctgagtaatctattttagttaaagatggtaaatcaaaggcttgaaaggtcaattaattttgccccctttcccactgatccatgagaaatggtgattctcagtgtaaggacctctgtcctaaattgagagaatgctctccaagagaccacgtatgaagtctctggagaagttattctggttggaaatataacaggttctgtttttgaaatgaccgatatttatggtttttttttttctctaaatatcctgctggatctctcaattgtcaaacaatctctgcccattaactcgtccttccttaggagaggctgcctctgttagttcttagtagaacaattcctttgctgtttctttaaattacattcttaggttcctatctgttgaggtcatggtgtggggtgagtgagaactgaattcaaatctacaatgattacctggtggcttcaggaaaatcacttcctttctgagtttgtgtcagctttaaaatgatgatctgggaatatagttggcactcaacaaattgaatagacaataagtgaggctacagatggctgcattctcctcttaggtcatatattcagtcaacacgtaatgattgagaaataatagaacaggctctgttctgggtgctagggccacggcagggggaaacatacaaagtgcctgctgtcatggagcttgactcctagaaagcatgcacatacataggtaagccagtactgtgtcaggtggaaaatgcactatgagtactgggaatggggagggttgtttgtgtgtgcatgtgtgatcttgcacatataggtgtgatgtgtgtgtgtttatgtaggatgatgaggatggtctcgctgagaagataacattggagatggctgaaagaaatgagtgagccatgcatgtgttagaggaaagagcattccaggagaagggtttgctgtgggagtgcgcttgctgggtttgaaacagcagggaggcagcgtgtctagagtatcatgagaggggggttgaggtcagggaatataggccttgaaggctactgtgatgtctcaggctactttcctctgagccgtaaggccggcattggaggggttcagcagtggagtagtagaccacagctcagtgttcctacaggaccgctctacagctctttggggtcatagactggctctaggaggcaagtgctggggacacaaggcccttgactttattctcaacattgcccaagctgcttagaataatccacagggatcatcacctaaaccaggcttcagagatgtaaaggaaaacaacagcaacagcaacagcaacaggaacaagtccacatttttagatgtgcctcaccctgtgctagtgagttaagtgtcagggcaggaggatcaaagccttcttgctaaggggccagaaacaagccaaagggacaagcacagaacaacaaaaaatgtgcatgttgggccttcacaaccaacaatacggtgctgtcaaatcaggtgaatgagtgatgggacatggatacaatggaggcattaaacatgttagacaacggttggtggtccttgccaaacctgaatggagactggacaaaggccagaaactccctgtgtctcatgttcctgtccccccaccccagtgtacacctgcaagaggtgatcagtgaggtggtagggtgagggtgctcgtttttgtgtagcagatggggagtcaagaacataaaaggaggcctgccaagttccttcccacttctgggaagggttctagcctcttattgagagaaggattagcatgaaggcaaagttgtttacctaaagatgtctatgagcctaagaagtccggtagacatcagccccatccacttcaacacatctaccaggagtgcctggttagtgccctcccgaagccaggtggaggctgccatctgctggttgacttgaggatttttacccaaatgtttagtttgcctttcaatttttagtgagacaaacctgtgttgacagcattttctccaggcaagatgctgtcggttttctcttttaaactatcacagattctcatcagggtaggtacacttcatgatcattttgatggatgctcagaagaattaagcaattagaccaagatgatccagtaattggaaaacatgggatttgagctcagctctcactaaaaagatggtgactgtaaagaaattgttataaacacgttggctttgcaaactgtaaagtgttatgagggaaccagtaaatggcaggtgctccaagtgtcctaattggaagagtgaatgaaagaataattgtgcagaaggatgttccttaaggcattgtgactcaaggagtcagagaacccagctttgacacttggaggctgagtgaacttgggggaagtcatttcactactctgagaaacaatttcttaacctgtaattgcaaatgtgctgggcaaatgtgctaggcaaatgtgggagctgtttttttttttttttttcttgacagagtctcgttctgttgcccaggttggagtgcagtggtgctatctcggctcactgcaacctctgcctcttgggttcaagcgattctcctgcctcaccctcctgagtagctgggattacaggcatgcgccaccatgcccagctaatttttgtatttttagtagagatggggtttcaccatgttggccagactggtctcgaactcctgacctcaaatgatccgcccaccccagcctcccaaagtgctgggattacaggcgtgaggtactgcgcccagtcggagctgcttattttgactgcatgtgtgtggttttattttcctgtaaaatgttgaaatccatgttacatcctggtgggattgaaacaattctcaagaaagcctttttctacttcctttacagagattgtaattcctctgggagttccctagggagggaggaggatgaggggagtgagccctctgctggttgcttatatgtcctgccagcccaaacctgggcagcaggcacatgcagggcacccctggtaccccattgaggctggggggcacaggtggccaggggcacatgcatctctagtgaggaagcaggctttctaaagagcaatgttgatgatgccatctggggctgaaaacccttggcaactctcagctgggctccaggacgccaagccttcaaggcaagggtctacctccatcctcacctctgctccccacactgtcatcccttgtgtccatccacaagcctccccttggccttaccactggtcttcatttctagctgcagtcaccttgagggaggcttcctgattccttccccaccctaacctagtgctccaggagttaatgggcccctgaatccagtctcccatatccctaactagcctgccttaattaaaactgatgcccacatccaggaaaaatccactataggagttgagggctgctcaggaacaagggtggggacatagagagctctctgggaccctaagccccatgaattttactttctaaatatctcttagaaccatagctctgtctccacgacaccacacttagccaggctctatcacctttcacctggattcctacagtagcctcctcaaaggtctcttcccactttgcacctcccagccaaaatccaaatgcaacaaaaaagatggcttaaaaaaacagatgtgatcacaatgctctcctgctgaaaacttctcagttgctttccattgaactgaagaaaaaaagcaaaatttttattctggaccaggaagatctgcgtggctgggttcctactgactcctgaaacctcatcttccacaatgcatcttttgcacctatgcctctggctttctctgtgcacagcgtgacagccataggactatagagatacctgccttttgccttctgcctctcctgcttccttcacctggttaactcctacttgctctttggatctgggttcaaatgtctgttcctcagagagccttccccctcagatcccctttagacgtcttcatagctttttatatttgcttccaaagcacagccctcagtttgtaatcacacatttgcttgtctgatcatgtgtttgtcactgacctctctggggcacagaggctgcatggaggcagggaatgtggttgtttcactcacatagtgctgagcataagcggggaggtgctcaacactgatttttaaatgaaaagagaagtgagaatcttagaaggagaccgacgaggacagcccacaaggagctctcggattttccgggcttaggcaaggcatggtgggaagaccagcttgggtggggcaagctgagaatggggaaggactgggctgtgtagccagctgttttgagagcatacaggtcataggaggctcagtgaggaagaacctgcaaggtgtgtctctccttctggagaacagacagtcatgccacactgcagaggagtatgcagcctggattttcatcagaatctcctgcctggttgctgtggtgcctgggatgatccccagcctcctctggactgctgcttccccatcttcagaaggaaagagatgagcacgaattcaatgcaacaaatattcattgagctcatcttctgtgcctcctgagggtttctcacaggcccaccctgtgtgaccaccctactttgaatactgtgaccctatccccttaccctagtcccctttgtccttattacccttgaatataccatttaatttgatcatttattacattcatcattcattgtgttttgttagaatataaacgctatgaccacagggatattttcctctttttttcactgacaaatccacacgggaggtgctccacaagcatttgtgaaaagaatgaagttctgttttccagttagtgtggcttgttgaaaggaataagatatcttcactgaaaagaacttggattttggaatcaggcagcctggctgtgaatcttggtctgaccccagtggcatggctgcgagaagccacctgacccctctgaggcctagttttctacatgacatggaatagttcgatttgtctcacaggtgactatgatgcttaggatactttggatatttaaagtgtcaaacacagtgctgggactacaagagggtcaataaatgtcacaggctcatggtttagggaggaaagtattagccaaggtatctggcttcaaggacctgaaataatctaggactacctaagcagaaaaggaattttctggaaggatatcaggaagctcataaaactgacagaaagtttgaagaagcaggcacagaaaattatcaggaaccaaaggaggccaggtagcaggaatcatcagccagtctgcctttgtcactgctggaaacaactgtcaccattagagagagatatggctataccctgcgtggtgctgggccacagatcccacggatagatggcctcagtgctagattctgtgggggagccagtctcctacactctatgttttgcattcattgctaaaggttagaagtccctctgtgggcatctaattggcaaagcccaagttacgtgcccatgccctggctatcaaggggaggaggaaagagtattttcctctgtggcttccttggtaggaggcaaggttctcaaatttcctaaaactggaaaggactttggatgctgggaagccattaaatgaccaataatcactataggaagaggggcaggaagtagaaatcataatggataaggccagcaggcagctgtaacagtggcactcagtgctcccaggggtgggcgagcctgccggggtccctgaggagagttaaaggagagggggtggaggagagccacagagcctagcacaggtccccaagtctagcagcagctagggtgccatgactgctcctaggctagaaggggcaagtgagagagcacttttctaaacctgaagagagagttgcatggagacagtcagttgacagtggctacggctctcttatgtggatgctgacagcccactgtgatgctgtatagatggagctgggcaacaagtgccctgacccacccccactcatagtctcttcccttcaatgtcctgctggcttttcccattttgacatccacctggaagctgggagtcattgatgcaatgaaaatagggtggccttgaagtacacagagcagggagaaggggagcagatgagagaaggaacaaagggaaggtcgaacaccctggaaattacttcccaatagagatattttgactgtttcatgggggcaggggtagggcccaggtcttgagggtgaagtggaattttaagagaactttcaagatggaagaggtttcctgaaacaagccacagagccagaggctgaaggacacgtttgagaaatgattagctcacactagagactgtggtctttgaatgccatggcctcagacccggttgcctgccctgtccccatttgggttattactgactcctgtttgatgtggcttcttcaccaatccaaatttgattcttgtgtggcttgtggggaataccttcaagcttaattaagtacatctacagttctggagaggagataggacttgggtttagagactcacaagtcagcagccagtggagaggtaagcctccaactcgaggcctggttgctacagggagcccgtttgtttggatttatatagccaggagagcgttgctatggctgaattgcatgcaaccgttcttatgatctggaacagcacattgtgtatctaacatgacagcatttattaaagcaagataaactcagcaacaaaggatatggctggaaccataaattcctctgatccttgctccagagccatcacattccatttgaatgaggcctatcagcccaaacttgacttattttattaaataagtcaattttctgaaaatccctaagagaatgaactgggaattactctccccccatatacccttgtttaaaaagagaaatgttatgcgttgagcagttctgactcactatatttgctgaggactaacagacctgccatccaggcaatgggttccccatcactagatgtgttcagtctgaggctggaggaatatgggcttgctccctttttggggactgcagtgtagaggagaaggcgatattcctaatagacattcttcctagttttcagagttcaggattgtagaagcctgaggaagcatccagttgaactgcccccatatcccattctgcaaccttcactctcttgccacagcacacatttccccaaagaaggagagattttcattaagggaccgggaaagagcaggaacattggagccagaagacctgggtttaaatccaaattctattatttattgagtagtagccacaatcaagtcattgggtttctatgaaccccagtccatctcatataaagtgataatgatgatagctaacatgtactagcacttaatatacaccgggtaccattctaagggcctcaaatggataacataatttattcttcacaaaaatgttctgaaatgagaagtatgagtgtccctactttacagaagaggaaactgaggcatagagaggttagggaacttgggaatggtggagccaagaattgaactcaggcagtctgcctctggggatcttagcccatgtgtggtaacaatacttacctcaactatatcatagagtttctaggagttgcattagaaaatgagtataaaagcatcttttaaaccataatctattagtcttggaaatactgagcaagatgctgaatctcaagttgtaagctttttttttcttttctttttttatttagagacagggtctccctctgttgcccaggctggagtgcagtagtgtgatcatagctcactgtaacctctaactcctgggctccagtgattttcctacctcagcctcctgagtagctgggacgacaggtgcgcactaccacgcttgcctaattaaatttttttttttttttttttctgtagagacaagttctcactatgttgctcaggctggtctcaaactcctggggttaagctatcctcccaccttggcctcccaaagtgttgggattacaggcctggcctgtaagcttttcccaagtgtgttcaactttatttaaaaaaagtgcttccctctctcccagtctttagtctcctttccacccctcccacttgaccactatccctacttacctttcctatcccaacattccccgctttgttcaaatgattggctttggtgaaattcagactcaacaattcaaagcaaaataacaaactcaaaagtacttgtgcttttatttaaaaaaaaaatacaatcaggtactgtccagaaatgttttggaaagaaagatctcttgaaaaatccttagttttcatcatcatcatcatcattattatattaataatattaatcatatccttaaaatggaaacagtattgcttttctggtttctgttgtatgaaatgtaaaaaaagggatggcttccaatgacacatttaatctttgctaacaaaaataatgacaattaattatacagcttcatgtaaaatacggctggttctaaaacaaactacccctgtacatcctacccctctcccattcccagagccacctaagagaagtaaaaaactattgcgatgttgtcactgggagatttttgctgaatcaaacaacaaaacagaaacatgttggagactgatgtctttggtgcaaagaaagaaatcacagaggaggtgaggcccatgctgttgccgttggccccagggatccatggtcagctttgactctcaccaaatgcccaggtgtggaccgatggttgggctggttgtattgatgctttggtaaaatcctttcctcgctctgggccttattcctctctcacccagtggtccctggaatttatgcccgtttgcgcctgccttcaagatttctgaagttgcttggtctcagcttcatctcagcaaactggattgagtgttcgtggcccttccagtggaaccagttaacgccctgttaaaaaaaaaaaagagagagagagagagagagagaaggcctccaggttggttactgttaggcgaggtgttcactgatcattgctatttagtcattcaaactaaatgagttctgtttcaatttgaccatttggtatatcacagctgcctcttgcctatctctctgttggtctgggttgtggaaactttcaaaggaactggctgaatctgacccagtttttcacctgagtcaagagtcgcctgagtttgcatggagctttggtctttcctcttgaggcaaaatggtggctgatgaaatctgccgtccttaggaataggttctgaaggagttcaggtcattattagaagttctagaattgaatagctacatacatggtgtgtgtgtgtgtgtctgtaattcacgagattcctatggagtattttgataggggtttggtatggaatagcagaacgaacagctcaacaaaacacagttttacaatttgacatatagggttaaatatcagtgttcttacttgagagataaatagtcttaagttctcaatatcttctgagcctcggttttactatttttttttctttcttaagatctgataatgttagccttgaaagatgagatgaagattaaatgagtttgtaaaggagctatcacagagctgggcacgtcgtaggtgcttggtaaatattacttccctagtctcaagtagggggaaatatccttgaaattttggccaaagctttctacaagaaaaaactgtatctgtgtcttggcttccaggtttcaactttgactcttcagcgaagtctgcagatggtagagtcaatccatgaaaccccacatggccccttgccccactgtggggaagttaatggctagtgagatgggaaaaaaatagagacactttatttgcttctaattgtttggcattcactgacatgggcagtttctgagtcttacagggatgtgaggtttaagaatggctcattcatttcatgggcaaatccgcttgtaattactcagttacagtgagtatggtagtccaacagcttggtgcacatgctgcctgcctttgccctggttctttcctctgatagttcagggttggaagccacgccttcttgtactgtggtgggcactaaagccagagagggagagtgactttgcagaggccacacagcaggaggagcagagctggagctggggctcccctcctgtggctcctttccatgtcatctctttcttcttccataattgaatggaaggatgaaagagaggcttgctttctaacatgtagcttgttggttttttttttcttttcccagaagaactttgtattatacgagtatttttgagacaaggcaataaagatgataaaataatgctcagaatggaaatattgatgaaataacacaataagatggaaacaacacaggactgctgtcaagaaatgtcctgtgactcttgcctcctctgtaaaacaggcatgaaaaaccacatcctaattcctgcacagggtaaaaatgataaacccttgagatacagaaggtaacagtgctttgaaaagtgccagaaattatgtaaggtaaggtctacacttaaggtcgcaggtgtcatttgctagcagttaattagggcataaacatgtgtatcaaagtgactaatattgaaaagcaacaggtcccaacacctgctgcatgtcaggaatcgcttgtggagtctatcaactgcctcccccctgaccccacaacaacaaaaatgcaaatatgcaaaaaaaaaaaaaaaatgagatgctgtgtcttgcctgagatcattgaatcagaatccctggggttatcataaagtggaatttggccctttgcatttttataaagtccttgggattccagtgagcagacctcataagcatccttgtggtccagggatcagcgtggtgtggccccaagggaagatccagccctcctcccagggatggtgactaacttctgtggagggacctgggcaggggtttggttatgattaagtggctagtcccacacagctttacacttttcaggaatgtgccagtgtaggcaaggctcagagtaagggagattactgaatttgatccgttcgcctatttctaaaagggatcgaaaaaaatctgtttctgtgattgtagaagtgctagaggtgtgtgtggtgcagggaaaatgccaggggctggaagtggggagagctggctctgctgccaacttcactctgtgacctcaggaaagtcagctttttctgggccttggtttcttcacaaaaggaggagatttaaagtctgtggacttcattttaaggtgttcttgggattccaaagatgccccaggccaggggttctgtgtcatcaaccctgcttcacctaaatggcctccacttttatctgctttacttttggggttcagacagagattttgtctgagtaaagcgttctgtttttggaatccatttgaccagtgtttgtccttgggactgtcaagggttaacctgtgctgtttctattttacctggcctgcagtgtccttgagattgctcactgccttgggaaaaacatgttgtcatacaagtaaggttcctgcctcctagtctctgctaggatagggagttaaattgtacttccattagccccctccagcttcccaagcttggcctgctctgggccctcacggtccactcacctgactgtggttattgtccccatatctccccatcaggttgacacggtgacagttcctgtaccagaaagcccctttgtaggacagagcacagttggtgatggctgaatctgtgtccttgtcaaaggtggagaaggatctgccattgtggtaggccatggagtcacctgggagagacagaaaatatggacctgagaaatctcagctgaaatttccctcctggacagtaaagggcagaaccagaggtgacaattgaaaggttctgggtgtgggactggccttgaacattgatcccagagtcagcattgaatgcggaactgaatgggacatgagtgtcaccccagtacttatttccgacagaagcagcataatgtggtgggaagagggctgtggctggctttggagagtctagcttcgaatcccatcttttcactttttagctgtgaccttgcacaagtcaagcatcttgttgaacctcagttttctcatctatacaatggaaccagcactttgattctatatactgagtagtgccattgtgacaataaaggtgtatgctaaacaggtggcatggcatacaaatacttactatgattgttatttttatgacttttctgcattccctttctataaagacctcagagagtaaggtgagaagtatgcatttaataatggcatgcttttctcccacatacaaatatttattagtcataattaagcccttcagacattagatgtccctaaatagtctctgtatcacatagttactttttaaagtattcatcagaccatgttccgtgattcttagacaagaagcccattaacatgtactactatttggaaatctaatttgtaatttaatatattgaatttttgaagcatttcagtaccattgctttgtgggtctcctcactcccaatccagacaagtgctgtgcacaaacatttcaagactctgaggcattctaccgtcataatttggagcaagttgtcaaaggaacccagatacctttttaactgatgatgctacccagagcatgaggacggcacgtagatattaatgaaacaggatgctctcctgcagaaggcctgggtgcagccaaatcacacaagaaaatgcagccttacaaacgttatctcagtaaagggaaatattatggctcattcctcaatggaagcacaaagagagaggaacagaggccacattcctgctgcttaatgaatttgcttgccctgtaacattcttcttcttgcctgaagccatctcaaccaaagaggtattcatttccaggtaataaaatgccaacattctttgagggattcaagaactaaagcaatgtttgcccctgggtgtctctctttattatcactaaactgccatctcaaaagagctttgtgcctccttaggctcagcctggctttggcaaccttttatctggagacttttcaccttatggatgttttctttcagggctcagggaggctggaaacgtgccaagcttctatctcttctgctctcacaaacataacagaaagccacccaaagtgggcatgggttgcatgggggtggtccacactctcagtcctgacccttctttgtcactgagaacattgtcggatgcagttttctgcagccaggattgcatccaccttctacaagctgttttaccttggacaaatcactgagctcttctgaacttctttcctcctctgtataaaaacaacgtcttcataaaatggttttatgaggaataaataagatgaatgcaggtggaatatctacaaaagaggatggtacctagtagggccttaatacatgttgtttccttatttatttctcctcttatgtggagccaggaaaccacacaaaaccacttcaagtccaagaaatcttcaagactggaatgaaggttatgagccagacaaggaatgcaggggccacttgagaggtgagaccttctatttatgaggatgcaggctgagactagatgaccacatggcagggatgtcttggaagagattcaagcagctaggtgatggagtggatggtttgctactcaagctgtggtccacagaccagcaacaccagctatattggcatcaccagggaacttggagaagatgcagaatctcagccccatcccagacaacctgtgtcagcatctggagattcacaagatcgccagtgggtccatacacccagagtaaattgagaagtgctggattggatgaatattaaggcctttggggaattttttttttaatcagtctacaactgatatctaaaactgggtaagaaagacacactttttttgaaagatggtcattagaaatcaatcctgattgccctgattcccaacatactcaatgtttcaggacccaaatatctacccaacacttttgaattgtagtttttctggattggcactcagtaggtacttaaatatttgttgatttaataaattgctggattaatgaggaaggaatgaaagttagagaaataaactgtaaatgtcaagaaggtctccatggctttgtaggctctacgtgcagccactactgtacctgctgtcccactgtacccctccaccttcagcttgtagcgagtcttggcatctcccacgctgaacttgtcatagacagcaaaggctgtctccccatggtcccgcaggtccacccggagctcgtactgcccctgggctgtgattttgttcaggttgtccagccctgtggatgacaggcaagggttgctaagaagcacaggtgactgaggccctcatttctatttcactctgtaaaagcggcaactgggtacacttaagacagggccaactgggcccagtggctcatgcctgtaatctcagcactttgggaggcagagatggggtgggagggggtgggggtgggggtggtgggaatcacttgaggtcaggagttcgttatcagcctggccaacatggcgaaaccctgtctctactaaaaatacaaaaattagctgggtgtggtggtgggtgcctgtagtcccagctacttgggaggctgaggcaggagaatcgcttgaacccgagaggcagaagttgcagagagctgagattgtgccactgcattccagcctgggtgacagagcaagactccatctcagaaagcaaaaaaaaaaaaaaaagggccatatcacacaggcctgtgcttgaagctcagtcttgtgcttgctggagtaatactaggctcaggtaaaatcgggttgacatttttgccccacttccaacctcccagtgcattagtgaagatccaaggagataaggtggtgaaagtactttttaaactctaaagtgccttacaggccaggcacggtggctcacgcccataatccccacactttgggaggccaaggtgggcggatcatctgaggtcaggagttcgagaccagcctggccaacatggtgaaaccctgtctctactgaatatacaaaaattaggagggcatggtggagggtgcctgtaatctcagctacctggggggctgaggcaggcgaattgcttgaacccaggaggcagaggttgcagtgagctgagatcacaccactgcattccagcctcggcgacagagtgaaactctgtctaaacaaacaaacaaacaaacaaataaaattttgtaaagtgccttacaaatgaagggcaatgaataatatagataaatgtttattataatatgataaacattttctggggtaggcagtggtgcatagaacaatgttctctgcagttaggtggttggaaagtgtggattgcatggatgaatggatgggtgataggattgtagtgttgacttaggagattccaaatttcagctcaactgttcattggttagactcctatgggcaaaccactcagtctttttgaggctgtgattttatccatgcgaggtggtgaggagagcaaaaatcacctggtgaccatcaagtaggactcggagacaaaaaccccttaactgagggatttaaaggtaattaggcttccgtatatctcaagcaagcatctggttccaggtttatttcccaaaaatttataggtaactggaacttctatacatctctggaatacatgcatatcaaaactcattttgcaacccttgctgacattaaggcaccaaaatgtctacaaatgtaatcatgtatcatgttctacatggctaatagggtccaaattatccttaagctcctgccttaaggtccataaatacccctaaggaaaaatccactgcaggggctgtaagtccttttgcagcattctttctttctaataaacgttcctttttcaaacctatactgttgttagtaaattcgtcttaccaacccactagtcaaccacttctgacacctgacaccttgcccacccggtggcaattgagtactttgtaggggtgctatgggggttaaatattatggctctaagaaacccatcttagcacctggagcacaacctggggcacaggagggaagatatcaatgatatcagtgaggaggattctatgactggtccagagaatgacttaaggctaggttaacacataagggctgagttttggttcttccttaatcagattttactttttgtgaaaggaaaataaaatcttgggaccccaatttaactctgccaataggaaaaaaaataaactgaaagccgagtcatgggagaaactgcctctccttttgtccctaagcagatgctacagataaaaggccagatatctccacagatagttattctatcttcactttatcttatgtaaagtgccgatttactgagtgtgagatgaatacaaaattgaccattctcttttttgtcattctgcttttttcttttttttatcttgcaacatgtggattcagtaatgtgaccatatccctccagcccacttttcccctttaaatactaaagctctcaacattatctctgaaaaaaaaaaaaaaaaaaaaaaaaaaaaaaaaaaaaaagaaagtcatggaccacaggttgttcctgtggctttccccctttaaacactaaaactcttaatattatctctggaaaaaaaaaaaaaaaaaaaaggcatggaccacaggctgttcctgtggctttgtgttctttttttctgggcgtgtccttaacgttggctaagtaaacctctaaattgattgagatctgtctcagatactttttggtttacattttgatgattcagagcatttaaatgatagtctttttcattaagaatttgacattctgtgtctgccaccagaagtagttcttcttcctcatctctttctctcccataggtccctgtgggttaggaaaagtgacaaggagggcagaatcaggcattttagatataaacatgcagggctgcattaccaagccagaattcttctctgcggtccccaaatccagcagcatatgccttccagttttggtagaagttctcgcgtccgtttttgcgtctcaggaacacctataaacatatcgatgaatctgggtgtacttaagctattgcaggaaagagggcatcgttgtgagaggaaggagtgtggcactgtggagagagcatcaggctccattctgtccatccctaatttgctatgtaactttgggtggtcacctgcccctccttaagtcttggtgttctcacctgaaaaacagggattaaaaataccacccagttttgggtgataatgatgtgtcaatgtaggttcattgattgtaacaaatgcaccattctggtgcaggatattgataatggggaggttgtgtgggtgggtgtggggtgtatatgaaaacttctgttcacttaattgtgccatgaacctaaaactgttctaaaaaaatagagtttattaattcaaaaatacactacccagctcctatggtaatggggtcggaataattcatcttaaactcttagcacagtgcctggtagataataaatgcttagtcagtgctaattaatgtaagcaatgggttcaatgatcaactgtcatttatacatcacagagttgtttgatgaggattggatgagataaactacaagaaacttatctccccgtttcaaaaagtagccagcgtgtttcccattcttttgtttaagagagaattcctgagtgcctctgtgtgacaggcactatcttgcaaggcctcacacatgggggtgtcagagtgcatcaggaggagatcaccctcttctcctcccctgctttgccctctccctcttcccctaggcctgagggctctgcagtccctggtggtactcacaatccatccacccccatcagaggtcatgtcacagaagacttccagcgcctcagccttatcaccattcagataaatggtgtagaggccagaggtcgtgtctccattcagcattgcttgggagcagtccttggggaaggggtacaggagtccaactgtggaataaggagaaatggtgatgctctcagtgcaggaggactgagctggagcttaattcttagcttaactctatggactagaatgcctggggaatttccaggtgcaataatgtgatgcaaacaattaaaaactcatagaaatgggcaatcttggaactatgcctagtagatgggtcttagagctgatgatcatagcagttcttttttctgatctgaggacattcatctgaggttgtatcatgagctgttttcttatttatttcacagccctagtataagagcatctttaggatacattcatagttagcatctggcataagatctggcaaaggggaagcactttcttcagcagatgtgtgcagaatgactgtcccgtgaattttcaaaggcagggctctccaaaggccagctcctctggtcctcaggaatggatgccactcttacttatcaatggaacaacttgcaggtttgctatctgcagaagatactttgtgacaggtgcagggggaggctccctgggcatggaatatctgagcccaactctgactgtaactcacaagatagtcttgaacaggtcatttagtctctgaaagtgtctgcttccccactagaactttgggcatagggctcaccataccagcttggtgggaagatcatttgtgattttgaatgtggacaggttttgtaaacactggcatgatgaaggagaaagaaagagactttcagctcatgttgaactctgacaataaaaggaccacacaattatatgggccacatactgggctaggagttcaaatgcaatacctcatgaacacttgcaaggtcctggtgacagaggatttattattaatctccctgtatagacgaagaagctaaagattataggatggaagtagcattcttaaggcacacctagcaggtgatagaaatggggactgaatccagatgggcttcctcctttcctttcaccgggatgctcataatctcccacatttgctttcctcaggcttccaagtagtagcagtgaatcgattcttttcagaggtttgtttgaaaattttaaagtagaagtcaaaggggaagtcaagggttgattcagtcaaagttagatctcaaggctggatggcaccctgggcctccttacttgtggtgaagatggtctggatcatattgctcctcaggggcccattgagtgcctggatcttggctgtgtagtgggtggatgggctcaggtctgccaggctgtaggaggtggtatctggacccacaatgacttcctaagagcagaagaaaaagtataatggcttttggtcacagaaattctcagggtatagataagaagtcattctatttataagttcatttacccatccattcacttacttactggacaagaattcattgagtacccactctctaccaggctccatgtgcactgctgagatatcagagatggggagagtacagcacaagcaaaggtccttgggccagaaggtgcagagcaagttaaaataatataaggagggagagaccgcatctggtaaggatgagagcactgctgtagactccagggctaaggctaccacctgcccaaggccctgccaaactatattgggagaatgggattgtaatggttaattttatgtgttaaattggctgagccatggggcccagatatttggtcaaatattattctatgtttctgtgaagggggtttttttttggatgagattaatatttaaatcagtaaactttgaataaagcagatttaaaacataaaatgaaataatataaggaggcaataagcgacctcaaccatacttagcttcaggtgttagaacagtggaaaatgttactagattatgaagggcctttaaatgacaagctttgaaacttaaagtttatcattaaacggagtgaggagccctgtaaggtataaatgctaagctttggaacttgaagtttatcatcacaagaaatggggagccttgaaagatgtttggacatgccaatgacataaaccaagctgtgctttaagaagcttaatctggtagcaagatgaatcacacagggtaagggactttgaggtcagttaggtcagtggtccctaaatatagctctttatcactctcagaagctttaaaacaatatgatgcctgggcctcatctcagactgatggaatcatcagagccagaagttgggcctggctatatttaagaaacttcccaagtgatttgaatgtgcagtcagtttggggatctcttgagttaggagatgattataatagccccataggcatggtaggattaaaacttaagctgacctcacatgtctctcttctagaacagagatatccatgacagacagatgttgaccaactctaactacacttgtagtctgtggctggtctctgtgctgctgtacagaggaggtcattggtttcagtttgcaggaaatcctctttccacaccctcttgctagcttccaattcttttcagcaaatgaccttagtgtctgggattggaattcaacctacactcctagtaaaccaagcacaacgatcttctctacaacctgcaaacagccagcttagtttgggcagtcatgcatcagtgcagaagcccctggaaggttctcctgcatcctgggaactgggaaggtaccttatcctgttttcttcaatgggagaattgagtttcagagaagctaaaagacttgctctcattccataaattgttggaggcagaggatgatcttgcatgcgggtttcccaacaccctgtccaggactcttttctcctataccaggttgattttttttctaagacatgtaaagctggtgaatggacatgcagaaaagtaaactgggatgagtgctcatttaatacccagaggcctttttgcagccccccagttctagtccctgggggaaagatcaactgtcagggataaagctgggttcattgaattacttaggaatacaattacctgtcagttctctaggcttctgtgcaaagccattttctaggcaattagggtactctagatcaaaatgagactcatgattcaggtaaacacagaatcctagaatgcctgacaaggagaagaccttaaagatggataagtccaaggcattcattttacagatgggaacactgacacccagagaagataaaggatttgcttcagctcacacagtgagatagttcattgttatatcaattccaggaaggggcatgatagttattagcaatgtgtccagttctggttaaatatgacagattggatacagccactcatctctacttgcttctaaaacccactaaaaagagagcaagagaatgtaaggtataaatccatgaagatgaggggaatgggagaggagacagcaacaggtgtgccagaaacttggtagatagaaagtgagtggtagagagaccatggaggggaatgaatgaagaaggctgaggttaactaaggagcatgggcagagctagtcagaggctgcttggtgcaagtcacagagtccagcaagttcagtaaaggaatgtgtacaaaagcagagatgtctttaaaggccaatgtggagtgtggttgaacaaaggtttggtttgtttagaagcttttttgtaagaaacagactctaagatctcctcattccctccaacagtctaaatgactgccctttcccattcagatggtaggctgaggtttactctctggaaaggttgagccagagaggaagtccggattcaaatccaccaggctcagccttcaaggaggccgaggtgctacactggaaacataataagatgaaagtttgtacacagtgagaggccaggttttatggcactgttatttgggggtcccccaagaaaactgtgggtacttgcccaatcattctgcagggagccacaaagttgacaagccctgcctgagctaactccctattagctctttcattcctagttcaaatacaaaaagacagaccatgatcaacagacattgggtggatgtctccaacatgaaagacagaaacccaaaccaaaccaaactcaacaacagcagcaaaacaaagaaacttgtaacaaacactgtgcaggatatagaataaaataccagcaacatattcttagagataaagagatgatgatataggaagcacaaacaaaatgccagaaaaagatcaatgtgtggagaacaagcaaaagatcttggaaatataaagtgagataaccaaaatgaaaaattcaataacaagtttggaaggtaaagtttaggaaatctccttcgcttgtttgaagatctaaagttatttcaaattaaaaggtaaaagaaagaaaattcttgggtagcgaatataaataatataaacactggataaaaatggtattaacagttgatatcataagaacacggtgaaacatattacaatatataatataaagataccatctgtgagataatacatatggcaaacatgcagagaaaccttttggcctttgttcaacaaaatattaaaggatcaagattccagctcctaaaatgtcctcaagtcttgtaagcagtggttcttgatcttggctgcctatcagaactggagtctggttaaaatgaaagaggctggagagtatgattcagaaggtctggcatgccatccagtctctactaattttttttttcagctccccagatgcactggggtagaaaaacagcatcaggtaattcttccatactttgaagatcatgcaaatgcttcaactagcattgaggagttgttatatacttaaaataccttgactgtgccatccactgattcatagaccagcaggtaaccggtgactgatgcccgggggggtcgccaggtaaggagggcagtttccgactgaacctcagtagcagtcaagtctcttggagaatcgaggtctggagaagacaggatgattaatatcggataagatcagcaaatgtagggcagaaattcgggctgggtatcaagaagactgggttcaagtcctttccctaccactgaactacgtgacctttggcaagaacttcctctgtataaataaggtggttgagccagatgatctccaaagacaaattctctatggtttatctcatcctaagggctggatgtttctaactggccttggttggatttagagagaagtatacagctgtgaacatcattatcaagccccttgtttctaagtaagaggatggatgaatgctaatatcaatactcaccctgacagagaggatggttcctctgtttccctgcttgctatagtttgtaaaaagctctcaatgtatagaaacctaacaaacatctaggaaaaattgcctaaaaaatatgcctcttcaaaaatattttcctgcctggaacgtggatcattaaatactaggtttagggccagtgggaactgtttttccacttacaaagccctcctcttaaaatcttttccttccccgtggggagaccaaggtcatttcagttcaaaaggaaatagtgtgtttcttcaggccttgactgagtgggcactggtgaatttaagtgatgctgatgtaatcacattgcaaggccctgacttaagaaagaagaactggctagcggttcctgtttaagatgcaggctgtgggtgggcaccccagaagggagagcttccagctctcagtgtctttgtacctgttgtgaacttggcagtgatggttgagctcttctggggccctttctctgcaaagattctcagtgtgtattccgtggcaggctcgaggtcggtcagagcatactccactgtgttcccggacaccgtgcgtgtaatttctggcactaaacatgaaatacacataccaaggcagtcacctctcactgtctgagccatgagtgggcttggcaaaccacatacacacctccttcgaacatcgaaactttcagtgaccctgcggaaaagcaggtctgatttctgaaatgactcacgctctctttctctctcttgagcactcacctcatacgtaaaggatttctcatatggagacttaatttttccaggccccaaatcagaaggaaggggaactgggggtcaggagatttttttcccacatggtactggctggaatcgctttgccactgagaccgaggtagaggacggtcggaggggacatccccaagcctgctgcccatgcttaatttgtcctgatgcatgctctcctctctttgtcactttttcacatgcccttttataatttactaagtgtcatcaagtcattaggctgaggggtcacaaaaactggacagcagtagctgcaccagagcctggccactatctctcaggcctgctgggtcatgtccagtggtggaaagcaatactgatcacattgcttgggggcatgtgtttatttcctattcacaggtgaccaaccatcctggtttgccagggactgcgggatttcctaggtgtggaacttctggtgctaaaactgagacagtaccaggcaagcggggacaagttggtcaacttacctcatcatttgtgagcaccaccccctcttctgaaccaagccccttgtttgccctgaatctacaatctccatggttcccatgaactatacctgattcattttaggtgcaacaccatctttcctgactcagaagagtttgctcacagggactatttaagaattaaagagtaaaaagaataaacccaacatccctcctccccatcagttccccacccctacctgtgctctgtcctcaaaaagacctctcttagttggttaccataactgaatgaaaattttcagaggctccaggcacagacgctggtgcctgctcatattgtcactgagagcaaaacaataccaaaccataaaatatgaaacttacctatacctggaaattgaaattacacaattatttctagagtagctcattacaaaatggaggggttcattgaaaagcactctctctttctccagtctcttacttatatttgattttactttctggcagctgtagtttgctggtgctctaaacaagtgtttaatctgtcaactgggtacattagcactgatggttgccaaacaagaaaacatttctgttttatttatttatttattttttatttttatttttttgagacagagcctccctctctcacccaggctggagtgcagtggtgcgatctcggctcactgcagcctccgcctcccaggttcaagcagctctcctgcctcagcctgccgagtagctgggactacaggcatgcaccactatgcccagctaatttttgtatttttagaagagacgaggtttcaccatgttggccaggctggtctcaaactcctggtctcaagtgatccacctgccctggcctcccaaagtgctggattacagatgtaagccactgtacctggcttaaaatttcagactttttaattaaatctgctaaaactagcttcttttgtggtctctgaaaagttgagactgctcagtatggcctgaagcggtctggttaagattttagattctggttttcttctttgtaaaagatgacaactgtttcctaaacggggtgtctcacactggtaggcagagatactaacaggagaggaggaatgggccaggaaaacatgtagaggctggagatgtatttttatttttattttaaatgacctaccagactcccttgaggtttcagttgggagccacatgaacattactggccttttcaacctacccatgcatttttatcatcctgtaccaaatgtggcagggagaagagcgaatgggaagagtttacagcaggaaagacactccttagagtgaggagagacttggacaaaaccttacctttctcgcctgtgtaggagatgacataactgtccacagtggcaatggctggctgccacctggccaaggcttctgagtcagtgatgttggctgtcaccaggccagatgggccatccagagctgcaaagaaagatggtggacaggagggaagtcattgggtgggacatcagactctagctgctctgctgtccacactgcttatggagtcctgatgttaggacagtgtcagctgcatggaatggttcagagacctaagcctggagccagcctgacctggctttgagtaatgactccctcccttgctggctcagttactttgggcctctatatcctcatgtgtaaaatagggatagtaattctggctggtttcatcttcagtgttattttgatttttccattatattatgggtggaaaggagctgtgtaaactgaacaaggctgaacacatgacaagaattattattgtttatattactttccccagagaaagaacttacacagaggggacttgcatagttaagactgcccgagccttttcttttcttttctcttttcttttctttgcttttttcttttcttttttttgagacagactgtcactctgtcgcccatgctggagtgcagtggcacgatctcggctcactgcaacctctgcctcccgggttcaagcaatgatcctgcctcagcctcccaagtagctgggattgcaggtgtgcaccaccaagcccagctaacttttgtattttcagtagagatgggttttttcaccatgttggctaggctggtcttgaacacctgacctcaggtgatccaccttccttggcctcccaaagtgctgggattacaggcgtgagtcaccgcacctggccccgagccttttctgagctttgagtggtatttctccttagatggcttgcagagaacataaagccaggctctggaggccggtggtcccgggttctaccatggcttctctgcctggtgcctctgtgccctgggaaaattcatttcccttctccaaacttcactttcttcagctgccaaagggtgactgtttagttaataaagactagctaagcaatgtgtgatgtgtaagatgtactagggaaagctctcaatacttgcagttgttattaagatctctattaaaggtatttgaagtcttaagtatggttttcaaatgacttgttctgagaaaggatggatattcaaaggatatttatccctggcctcttttaactgacctctcctactacccaacatcactttctcagaagccagcatgaatctgaccatttcctcttgcttttgcacttactactcaattgtgcccatgccagcagccctggcgagggtggagggaagctatcctcagctcatttcacagagaggcacctgagccttgagggatgaaatgactggtctgagagccaggatgtggcagggcaactggggagcccacattgtccactctgagttccttcctgcttcactgtgcatggacagaatctcctttaactggtgatgacaatggggcattgggaggaactacgttcagcttttgccatctgttgccgtggagaatccactgatgaaagatttctttggggaaataagggcctgtgaggcagggtggacgggactctgggttcagatgggatattttaattgtgtgttgtcaactctttcaggctatgaggatatttttaaaatttcctatgaggtctattctttgtatcccttaatgagttggactggataattgctcacatatcaaaggataaattgttttgagacatggctgtctgaagagaaattttccacttcattctccttcaatgcaattcattattttcccctctttacagtgtactgtacaaatcaggttacactaggaaaggaactctttattttagaaggatagagagtttggagtcagaccgacctatgttcaaatttggttccagcatttactaattatgtgggcttggccaaggtatttcatttgtctcagttgtctcctctgtaaaatggggatgataatagctgtggggattaaatgtgaagggtttagtaacagtgcctggaatgcaagagccaccaaatagagaggagctgttttgtagctgtcaccatcacatgctcatgtgaaacacctgctttgagggacactcacaagggttccaggcaataggcggggaggtgaaggtgatggtgggctaacatgaacaattgtatttcaggatgctttacaaacacagcttcatgtgatccttaccataccctgtgagggaagcagaattgtgtctgttttacagagaaggaaagtggaccctagtaaaatggactgatagctcatgtagttggtagaatttggatttaaattcaggtaagtatgactcccaaacttggactttttctttcacaatagtccaggaaatggaggcccaacaaggttaaggtcacccagctcaccagaggctgggatgggccagaagagaggcctctggcactctaaatccagttcactttccactaggatctcataaataaaacccccctttttttccagctgctgagtcatgagctacaaggctgaaggtgagaaatggcataggatgcacaagtgacctctgaaaaatagtaacacacacacacacacacaaccccaccaactcacctgtggtgaatgaccctgagacaggttcactttcctcaaagcccttcatggcgatgatgctgacaaggtactccacgccaggtatgagtttcaccagcctggtctgagtcttggttccgtccacagttaccatggagggtgtacctggaacacagtaaaagcaagatgaggaataatgaacctcactgacacttattcactgttgcccccaaaaagagtgtatctgatttagaaatgaaactatatcttcatcaaacaccactttcttgacttctcatttgctcctaccctctggcataagggaagaaggcttactttttgtatgctttttctattggtgcagatgccaaaaacaaagccaggaggggcgggggaaaacatgaagtcacaacgtactaaaaatggcaagtttccgttcagtagagagctggcacgttgtgcaaattttatcttattatttttccccacaaacaatatgggaagcttactatgtaatgtatgtcagatctattgcacccattgtcttggcttaggattatagactcccttactagaggaaattctacttaagaaaagaaagttgattatagtcaagtttgtgctgcagtgtttattaataaacacagaaattgtatttcttagaatttgggggctagtgaagaacttgcacatcagctggtcagacttcctatagagacaaaacagcattcctgtgaagaggttattaaccatcctctctttatacactttcagcaacaggtagcttactacctgccagagtgtctttaggcagatttgactgggcttcctccttgtggtctctattatagcccatgcgctttgagttagaactcacaaattttctaaggcacagcttgccatcatttgctgagacagacagatttggtacccaaaggtaaaacttcacatatatccaagactagcttttcagatgagtgtgcgcagggagagaaatgccaatatatttagaatcttttgccattgtgtgcaaacaatactagagatctatttctcatagaattttataatttcaaggttaaaaaaggtcttgttcaagtgacccttcacaagaaagtttcttctaagaacctcatagcactttacaaatgagttctcttctctccagatggtctcacaaataaagaattcattttctttgatcatgatgttagaggatgaaaattatcagggtctttttcatgaatccatccaaacccacaacactcctcctctctctcccctttccgagtctcctacctcctgtaatgggcacataggtaatccggaagctctccacttgggctgtgggtgccctccagctgacagtagccgaattttcagtgatgtctgagaaaatgacttcctttggggagcccatggctgtcaagaagaaagcacaagagaagcccagaaacagttaactgtcttgttcatcaatggttcttcctgaattccttatttaggaaaactcagtgcctagaatttgtgtctgagccaagcctttaggatggagaatgtggtgatctgtggttaagttgtgacttgctaggaccaattgtttcatttcaggtacagggcccagggttgtagaaaagtcatttggtctaattcaaggggagtgataggaccatagctgacttccaaggaatcgtgggagaatggtttcccagattggaatgtgacccccgttcatttttgatttttaacattttcttaaatctttgctttctagttccttttattaaataatactaagacttgacaactgtacagttctttgcaatttataaggcttaatcctcctgtagaagcccccaaaaagatgtgattatagccattttacagagaaccaaaccaaggcttccatgaacattcttgtgatgtgatctttctgggtcccaggagtaggcagcagagccaagcacagcctggaatcctggaaataacgttcacacaaacactgacctgggcaaacccattcctagaactggaaggaggtccaaagccaagagaacaacctcaggctcatcaccaaagcaaacacccagtggacgctgggtctacctgtgagaaaagccatgcccagggggagtttctgcctcccaaaatacctcccctcaaaacccagtttcctttggcttttctctgtgtattttttggctgcgatttttgccctcttcagctaaccatgcctacccagagaattcaggaaacaattttcaggctctagggaactcacttcctcatcttttcccctctccaacccacagggattattacatgctgaaacccacagaaattcagcaagggtttttttttcttcctctttctgcatttttctctcatctaagacatctcctcctacagctttcttctgtggcctggtagccacccccagactctgtggctgcctgggtttttgccctgcccatggaaagtttcagaaaccacatgggtctctggagcctgaaagagcttcattgtccaaataccactgagaggctgggtgaccttgggcaggtcccttcacttctgtgaacctcagtttctccatctgtccagagggaaaagtggtacccacccacagggatgttttgaggattagcagagataacaaatgtgaaactcccagcacagcatctggcatgcagtgagaattcagtaaatatgattgccctctctttattttctttccaatgtccctctttcctccatgggccatactagactttaaggtgtcccctaggaaagatcgagatgagtctaactgggaaaaaacaaacaaacaaacaaacaaaaaacagtgaggtgtataaactcaggcactgaggacttccctctgccaacctggtgtactcgcactattgctttgactgaaaacctcattggtgtaggtacattttagtaggtgtatcttatggccaaacacattaatagctaatatggttactgtgggtaaagaaattctgctaaatacttgacattcatgatcttatgtaaacctcgtggctgacctttgagttaaattctattttccagatgaaggaattgaggtagagccatgatgaaactccaaggacactgtcccatggttgttggcttaaccaccaggcaacactgtctcccactgccctttctactgccctgggcacccagggctggcagcttgtgctatggagaggtaccttgtgagtgagaggaggagctacagcagggccttctcaggaggaagagggataggacattacagagaagagtttacaatggtatgagggaggaagagaggagaggagaaaggattaaaaaaaaaaaacaaaaggggaaatttataaacttgatgaggtgaagatagaaattaggcatcttctgtgctcaagagccccctttcctgtcttctcctggtcctggagcacaggcatgtagacacacacacacacacacacacacacacacacaagcacgcacgcgcatgggcacctctctttggctataagctactaggctctagagaagaaaatcaaagagagggctttccaaaagagcagggtctgccttgccttttttttttgttgttcttaaaaaaaattcaattcatgattattcattctcttttttgctttagaactgcagggcttctagaaaaaaaagatcagcaaaacaaatcaatgatcagaagaagtaaacttcgaagaacactgtttataaaccaagatcaaaatcaaggctctgcctctgatctggagtcgttttatgggcagccacagggaggaggagactgagacctgcatcccaggatagggtgtccctgttaataagaaacagggtttttccctcttactaggttgctgcctggattctagcattttctccaagcctacaaatactgattattatttttacatgggtgatttcttgccacttattaggtcctgaaaacttaacaatataaaatatctatctttagacaaaaaggagaggttttggcaaatgtcatgcctatgcctgtcagagatggcaagtagctatatgcattggttttctctcatccagactgctcattttaaatagtattagaataagctggtcattgggctttactccaaatctagctctatgatcatagaaaaatcatttcaccattctggtcctcagagtcttcatgcacaaacagaagaggttgagctacatcatctctcaggtcccttttatctctcctggtgattttgtggttctgtcccctggttccctttgaagcagccatctccagcgaatgctatgtctctgcatctccctcagtttcatgaaataatttacttgacttgttggaggtttttccttttctctttaaaaagtcatgttcatcttagtattattattattacaaagagtcatattattactactgttattattatcattatttgagacagagtcttgctctgtcgtccaggtgggaatgcagtggcacgaacacagctcaccacagccttaacctcctgggctcaagagatcttcctgcctcagcctgcagagtagctggtactacgggcatgaggcaccacacctggctaagtttttgatttttttttttttttttttttgcacaggtagggtcttactatgttgcctaggctggtctcaaactcctggactcaagtgatcctcctgtctcagcctcctgaaatgctgggattacaggtgtgagccatcactctgggcctaagagtcatattattaaccatcttttttttttttctccttgaaacagctcctatggaaaaaggtaattaaactccaaggacactctaggtgcctttcagagttgttatgagtatcaaagttagagagcttcataaacagtagcatgttaatcttgccagctctctcctttatccttgctgatcaccgtactgattattcacatgtagcattttataaatattaatgtgtatagatagacgtgctgcttctccattatctccctacttggtatagctcgaacatttggccaaagaacaaggaagtgtatctctggataaaatgatgagatatgatatgatgagatgagatatgatgagataatagatagaaggaagaatctttggaacgtaaaaaaaaaaagatgataattgtaacgatgatgatgcattaatggcaacgtgaatagctctcatttgctgggcccttgctacctgccaggccttccgctatgggctttatatgaattatctcatttaatcctcacaaccctattaagtaaatggcatcatactttttttgcataaggacttagccaaattgtccaaggtaacacagtctgtaattgaaagagtcaggatcagagcgccagcctgcctgcatccaaagctcctgtgattactcagccctgtgagaagaagacccctgagtcatgacttttctctgttctctcctgtttatttacagtacctgttgttgctatagcactgactgtctgggatcgccttcctttgcttattccatagagttcaatttcgtattcagtagcctctctgagacctgttatgtccctggtacgttcgggggcaagtagggttatttccagtggctcagactgctttttggtatctctgattttgagaacaaaattgtcgaagaccccttcatcagctgtccaggacagacggaaaccgtctggggtggcatctgaaaccagaaggttgtcaacttccggttcggcttctagagggagagaaaatggtgggagaaggaggaaagacaacatcatttaccagtccgtgcaatcttctctccagtaggggtatcaatatgtagtgatgccccggctttcagagatagaagtgtcctgagataccaaaaataaaatcattcaacattaacaagtccagtagagtcaggagaggggaaagatggagtagacacattcaatacaagtcaagcatatgtttgcatatgtgagttttgtctaaaagcaattcagtaaatccacatctggactcagcattggcccgtcccacatattattaaataagttcaaagccagtaaattgtttacatttgctctctgtcttccagtggctgagtgcccatcccctgcaagacctttttcttttctttttgaaaagacaaataaaccagcattaatgatctgtagagctgctcatgatgatactgctgattacattctccttgagcctgcccaaaatggcttttaaaatgttatggtctttttgctttgttcttagtgctgtttcactaaagaaggctcctacccttgactttttttttttttttttgcattctttcttgttattttattaactattagataaatgttcagatggtagaactgaggttggaaccttttgtgctacatactgtggacccagggtttcatcttgcattgccttaactagacaaaactcaatgtcaatgtagatttagagctgagtttcccaaagtgtgctcacagtgaactattcctgtttgatcctcttccttaaaaagtatcctttgtcaaataagtttggaaaatactgcctggataagtacttcttggagatgatgcacgttagggtgttctgaaaagccgtgcagttaaagatcctctttaactttgtttaactcagtctttccaaacttatttgaacgtggaatttcctcaccgagtaggacctttgaacattctgtggagctagtaatctctagaaagactttgggaaacacagatgtttgactattccgttgttaatttctgtaggaatcattagtcttgagaaaattatggatttagtccgtgttgcagagtctctctgatattagtgattaccgataaaataagttcacatttggttttccaatgacgagcccactgggtaagtttgttaagatcatggttgagattttgagatggcaaaagttttaaatacgttttggaaatatactcattggtatatttcttttgagaaggctgaaatgtagctggggaccagccaggttgatcacaagggacgatgatatgaggtaagcacacaagagctatggacaagacaaggtctaaaggattttgaatacaaagcagaaatatttcgaccttctcatttctggggtgggagtggggagtgttcattaagtacatatgacaagagggagtgtggggagaaggtgaaacagtagactacatttatggattaagtagggaatgtgaacaaagatgttaaagtcatggcgatccggtagacagattacacagaaggggaccaggaagaggaacaaatggctcacttgatttgaaatacctgtaacaatctcagccctcaagggcttggtttgatgcccttgggtgaagccagagaccataacctcatagccaatgccagttatgaggcctctaagctccagcttcctctgggttcctgaaagtgtgaattcctgggggtccagcagcttcccagaatccaccaccgttactagaaagctgtcaaaggcattctccgatgccatccaggaaactgtgaacccgtagggattaatgtcggaaatggttaggttttccagaaggggcagggcctctgaaagaagggaggagtgaaaataactcaggttagcagcactgactctgtcaggatagcacacgtttccaagaacaccaatagatacccaagtccatcattcaatttgtgttatatgcttagaaaatgaaaattcagtaagaacttattgggtgccagatagtgttatcttgtgcaattctcttaatagcccatgaggtaggtattattctaatttcacacgtgagcaaactgagtttcaaagaagttgattgacttagctaaagttacaagcttgtaagaagagatagagcgaagattttagtcaggtttgactccaaaggccatgtagttctttatacaaataggttgcattttgttgagtttggatcccgttgtctacttcccactgccttcagctctttttttttttttcgagtataatttctttccggtatacttcatgtgtttctatcccacttctagtgcacagtttgaatcaaattaatgaagtcaattagtgagatatcctcacaagctgaaataaagggaggaggtaagttttttttgtgtcaaaattaatagctcatggttataacccactaagaaatgataagatttgctaaatcttttgctgtttattttcctggataaagttagaaaacaagaacacatctgggtcttagtaaattctgtcaccatctctccttcattcgttcaccaaacatgtatgtcccaggcattctgatttctcaggtgctaaagggccttttcacacattgggatatccaaaaggagtgagcttatgttggctaagtttccattgatacttgccaactgacaaggcttcacattgttatcctagttagtcttcaaaatgatacagtaaggtagatattgctacctgccttccaaccccgatcacatctaaaaaaaccagagaggttaatgacttatcctaggtcatacatctgctaggtgcctaagctgagatacaatcaggtcttccgactccaagttctatgttctttccatacccaaagccaaccccaatcagtgatggcaatcctgagggataaggaggattagtggagaaggttcagcgtctcttttctaggtgttttttcttttttctttttttttttctgacagtactggtaaatgcatttttttttttaatcagaagaaaaaaaggagacaggaatttcaaattagctgcatctagtttagacacttcttttccattacagctaaatggaaacttacaaagagataaatgctcttgcattaattcactaatgcctagggtctaatccatgagacataaagaaaaatgttttaaaaagaagtgtttggtgactgaatgaataagggaatgaataccttcattttgtaaatagagatttaaattttgctgtggcttggacttcctgtagttattttgaaacacttggtgtttattctgaggcagttttttccacgtaaagatttcccaagaatcataattctatcaaaagcgaggatgaaatctcttatactgggcaaacaatcttcatctgagagacaagggtctcgaattctgttcctggattttgtttagataagtggcatctctctttgatagctggcctctttgcacctccacaccatcaaagcagtgaattccaatgaaagtgagggcattcaggctaattaggcaatcaagggcttgttatttaagagtccctcctgttttgtttttttcttttttaatatgcttcttttaaaacgcaatcttttcacatcatggattagctgagacaatgctgtaactggatctaggattcccaagactgggtctctcagcttccttttcttctgttatgtgggaggtcctgcaagccgctacaagcaatggcctgatgggatctgtggccatttctcccctcctgaggagtgagaatctcatctcgttcctccttgtctcagtcccttaagaaattaccatgttctgcatttgaagactcatctgaatgatttaattcacattaggtaactggataggaaaaaatactcattttttaatcttacattaaaacacatccaaagttctcttaaaaacgagagggagttcatgattgcataggtctattgttctatctagccttattggttatttttaagaaagccactttcctaataatgttgggagacagcagaaagaacctagcatgtataaaattcctactggatgctaggcagttaaatttcaccaactctatttaatctatgagacaaggctcccagaagtgcctgtggtatcctctctccatgcataaggaaattagggttcaaacaagttaagaacttgctaaaattatgtagctaaaaagctgtgggagaggtttagaaaccacaaaagcttgatctcaaaatcctcactcttccaggacaccatgctgcctataattaaatatttaattgtactaattgacatgtcttagtgatggcaatttagaccctgggagagacctggtttaatgtgaaaatcagatggcaaagtccgtcttctgaaaattatcactaatgaaaaggaagagacttctaaatattttctgaggctttttgggctagaatttagtaaactgacaccatgtgcagcctttgccattgaagtttttgctgccaccatttggcagcatttgccaaattgaacattggcaaatgttcaagaagtcaagttgagtgaatgggtagggcttaattaaacttgaaatttatctgccatctgaggttgaaccttcatcaatcttccaaccccgatcacatctaaaaaaaccagagaagttaatgacttatcctaggtcatacatctgctaggtgcctaagctgagatatacaaccaggtcttccgactccaagttctacgttctttccatacccaaagccaaccccaatcagtgatggcaatcctgagggataaggaggattagtggagaaggttcagcgtctcttttctaggtgatttttcttttttcttttttttcttttttttttttttctgacagtactggtaaatgcattttttttttaatcaaaagaaaaaaaggagacaggaatttcaaattagctgcatctagctgcatctgtgttgtcagttttaagaataattattttttaaagaaaaagatggttatacttttgtcacatatatgaactgcgttacctagcatgatttatgaacaggatttcgatcttaggcctttactaacttaggagtcactttttaggcagaatctctaaactagggataaaacagccaataaaactgggcacaaaaaaccctaaaagctttatacaactcttgagaacgttctctccacttcctaagagcagctgtgaaagtcctctcctttataatagtatctgctttctctttacttagaagtttacatatattatcttggctatcatgagtaatgtattgtaacctgtgtctgtcaatggatgaatggataaagaaaatgtggtgtatagatagatcatatttatatataaatatatacattccatatgtgtgtatatatacatatatatatatatacacatatatatataatggaatactttatagccttaaaaaagaggaaaattctgtcattttcaacaacacggatgaacccagaagacattgtacagagtgaaataatcgaggcacagaaagacaaatactgcgtgatctcatttgtgtaatctaagaaagctgaacacatagaagcacagagaagactggtggttaccggtgactggggttggggagatgaagaaaggggagatgttggtcaaggagtacaaagttcagttagacagaaggaataagttttagtgatctactgcacagcatggtgactggccatagttaataataacatattgaatacttcaaaattcctaaaagagtagattttaaatgttctcacagcacaataaataaataaataaataaataaataaataaataaggtgaggtgattgatatgttaattaggttgattcaatcaatccacaatgtatatgtatatcaaaacaacacactattctccataaatatatacaattactatttgtcaattaaaaataagagagtacacatttgcagtgaagattgtatttttgttgaattttcctttaagatgacttatctccttttctctctgtgttagacaagtgagaacctctgattgagtacctgtaatgacaaaggcagtgaggggtctggtgggatccccagccaaggtggttcctgccacactgacgtcatagccagtgttctccaccaagcctgtgatgtgagcttgctttgcatctcctgagactgtgaattgctgggactcatgcagtgagtgagcgtcactcacattgataacaatctttgcaaaaagcccagcttgagtggtccatgacatgttgaagctttttggagtaatattgctaaagattagcgtgcccaactgtggctttggttctaaagaaggaatatgggcagagagaaagagagagacattattagaggaagcagtggatttttccagaatgtagccatagaacatgaaagcatcaatatctccaaatacatacagaagagacagtatgttaggctgtgtctacacctgcattgaatatgatgatagaaaatatattgctttctctgcaggtgtatatttgtgttctttatttttattttattttttagatctgtgttcttttaaagcataaacaccaccatttgctagtcatgtatgaagaagagtagacaagccattagagtggtagattggagtaacgtgaagggtattaaggctacattttctaaagtttgtactggggacacaagccctgtaagatgttccaagaaaagacagctttatgattaagtatgcatggtaaacaccgaatattatgtcttaccatagagattcacaaggtgggtttgcattttaaaggctctgacaggctggttctgtcagtaaacctgtttaattttgtttggcccaaatttcataaacttattgatcaatgtataccctatctgaggaatatcctttgaacatctcaaggagctggtgttccattgaacatgttttagaaaatgcttctttggagtttcctcatttagtattcttttttagtatctactgtttgcacaaattaaaggctaatacccatacaagagaaatttttacagtacttaatatgcattgtaggaaaatctatattttaccatttaataccgtaaaggtgaagatggcttccattcaaaattcccagtgaatgcaaaggtgaaagaaaaacttgaagttaggcattgaattttctgcttaggaaactcaattattggataatttggacagatagatggtttccctgaggttaagtatctcttttctgttaaagtctagacattcagttttgagagcaactcatttaatgttaaggggtctatatggctagatgtttatggggctggcctcctaaatgctcatttatcaaataaaactaattttaaagtaagtgcggcccagactgtattttagagagaggcaacagtactggaggattcagatattaagatcaggatttagggttgggaagaggcacaatatttcttccaaggacttgggagttattttgcttcagctccaaagtttggaggaaagaaggggctcatttggataaactttaatggcacaattatacagcataattcgatgtcataaaatctctaagaacaaaaaggatttggttcagaagcagaatatagccattagcattgacatgggatatcctccttatcaattagtttcagaaggtaacaatgcaatcatttgcagctatagctttgacaaattccctcaaccacacaaaagattaaaatgttccaagtggaactctgttatttccctatattttgctgtagaaacaatctcccaaattaaggatgcatgctgggattcttctcatgctaccagacagactatcaatgccaacagattcaccatgcagaataagactcaggttcttgaggtcagctttacctccagctgcctctcaaagggtgcaaccaagctgagaaatgagatgcaagaaaaaacagagaaagatagtggtagttagggtatggtcaatgttccatgcaaaatgaggggcatttttctcccaccactttaaaccttctgaaatgactcatggacatgctagctgcttccaggaaaaagaaacattttcaaaatttaatgctctgaatattcaccacatgcaccaagatttggacaagatgatggcttgaaagaagagcctgagactttgtgacagctatcagtgggtgacaaaatgtgcttgacaaagtacatgtcaaaaaagagtagtcttcagacaaaaatcacgagaacaagataagactactgggtcctctcatgcaattcttgggttgtgattcagagtctattctcagcatgctcagggcacctttattttttaaaatcctgctagagagaaaaagagtgtagatctttctgaccaagtcaccagaaatggcatgcacatacctctttgaacatgacataggcaaactttgattagaacgaccacaggcagatgataatgggtgggattgaaaaagattattcaagatcagatgaaaagatgatttagaaattcaaccaaagcaagtcaggttaactttatacaaacaaacagaacaactccagatgtgaatggatatttaggaaaaagaggtttgacactgaaattctttaatttggggtgagagttattttaaagctttaaagctttgatttggatggctctatcaaatttgagaaggattgggagcaactaggagggtgaaaagtgggtagcgggtgatttttggaaagctattcagaggaaattcaatgaagagtgaagaagccataataggaaatacctgtggttgcttggaccatcagggtctgagcacgctgcccgccaatcagcccatgaaggtgggcagtgtaattagaagaagctttgaggttggtgatgacagagctgcgagacaccccaggcacagacagcaccatggtctcatgggggtgatcggaattactaacttctataagaaagctatcaaaggcagactcctgagcttcccacgagatggacacactgccccaggtcatgtttgagacagtgaggtggctaagaagaggtttggctactaaagcaagaaaaaaaagaaaaaagaaagtgtgtcaatttaaaacaccattgtagagtcaaaatcaaaacacataagactaaatccataaagttttagactttaccctttgttaatggtaaaataatttgtcccttgttgaaaatcggtttgagccatgagaaacaaacatatatgtttgcctaattttctcctctaagtttttttatacttgaacctggctgagatagcaactggataatgttggctctctctgccttatccatggatcaccctgacgacaatttgtagcctcatgtagaatgaggacagaccctctctcaaccatgggtgacctaaatgacaggcaattttgatgctacgatgtcaacccttttcttggatttcccagaccatgagtcccctttttgtaaactataaggaaaaattatcctgtgtttgttctgtagacaatatttttttttctagtttgtgatttcttcatttctcctgtgtttgttctgtagatattgtttctttttttctagtttgtgatttcttcatttacctctccagagaaggcactgtctaaattgtgctaagaatgctactttgaatgtagcattagaaaggggggctcccctttctaaattcacatagggttgtcttttactgcatggcaaagagcatctgacttagtgcacatctcacagacaccacaaatttaaagtgagagcagtttattcttttgttttttaaactaagtcccttgtttgaacacaactattctacttttatttttgccatttatcattcactattctgagggcaagacagcatgttctgatcttctagaggtggtgttggaactggggtggtctgaatggcatggctgcctcctgcactcatctgataagtaatctttgctgtttccctttactttcccagttggaaaaaaatacccaacaccatcaacatgattattaaatcactgggatatttgggtattgcgaggtccaagagactaggaagacaaagacactaagataatacaaaataaaatttacaagacctctttgactgaggcagacatctttcaaagtcaagaacaggtctagttatatagctttttagttatgagaggttagaattcttttctctagattccatatggcaaattagactgaactacattttatgctgtaaacatcctggtcagtgataaatcaggcacatgtctttatggcaatgcattatttgggctgctgttggaaaagagttatgttaaacagcaccccagcctagcaccatggaagagttagtgccctgtggcttgtacatcaatgggagaggagaaggagaggcttcaccctgcaaagaagactgtggagagagtgcgttagaaatgggagaatgcacatgtacctgtcgtggctgtggcactgatggttttggtccggatgctgggagcaagtccagagaggtagacaataaaatcagtactagggggtagccctgagatatgggcagttcgttcagcaccagagatattatattccacagtctccagcaacctattggaatcaataatttcaatggtaaaggtctcgaagatcccatcggtagccatccaggagagattgaagctctcgggagttatgtcagaaacatttaagtttccaatttcaggttctttggctgtaaaaggaaggggtaggggagaagaaaaaaataaatttgagttaattatttggctgtgttttaagattgaggttgttaatagaaccattgctgggtagagagatctgataattcagggctatgatggaaggaagcaatgttaccaattagtgccaaagggagagaaaaagcagttttgttaaaagaaattagaaaaaggaaggtatggcaattagatttctctacatgcagttgccacatataatcaggccctggccaagaagatgtgctgaatgatcttatcaggaactgttgcatcttaaccacacttgcctctgggagccctacctcagggttgctggccactggtcaaaagatatgagtcctggcaacttccagtctcttgaattgcattaaggaaaccaagattacttggatgccttccacagacattctttactttgaaggagctcccatctattcaaatgagggctaaataattctgatgccattaccttcccaaggtggtaacttgaggcttctgattttgtgacttaatggtaattaccaatttctcagtgtaattcttggtatttttttcatactttagagaaggaccagccagccattctcatattctgttaaaatagcttgtcctctcttaactgctgctatgtgggccaaaaaggctagtattgcattgccaaccaagagggctaagccaaggcaaggcagtttaggccatccctttcagcgaagaaataacattttgtcttgaagatggtcctgccagtgctttccccaaccataagaataaaacatgcagagggcaggtaggagcagggtttgaaaagctagtactgtctctttagcaagaaagaaggctcctggtctctgagatccttctaatagatttgttgagatacagatcagatgggattatggaacttcctgcccataggccaattcatcagtggcaagaatgttgctattgttaagaagaaaaacacacacacataaaaatactgaggacacccaagccacaagatctgcagaaaagatcagaagtggtgggtgattactttgccttctgggaagggatggtttatgggtctcagaaaaaggaggtccgggtgccttcagagtagcctcggctgcaaattctaggcatttcagggtcaccgtcctggcagtggttgcctgtgctttatgtttctttatctcagtgaaaattagtgaaatgactgaggttaaaatgcagagctatgctcttgctagattcaactgggatgtacaggtatgcattaaagtttagttgcaataattatttaaaaaggggagcagtcatatgcaaaatgaagcgatagtctctaccgagcttcaaacccatggaggcacataataaagatgagcaacggaaaactgtgtcagaggaaggctgctgactttggcaggcccccgggaaacactgaagtcttgtaacaggggtagagtgacgagtaaactataatgcaccctcctgggtctggggctgggagtttgccatccaaaggccaacactccagagagaaactcttgattaaaagagcaaaaagggtatcagttctttgacattcatagcccaggacattccttgttccaaaagctgctgtgtgtacttgtgctaatgaatggctttctctttggtacagtctccagtcataattgtgtaatttctttttttttccttctggtctagctatttgctaatttgatgttctaacaatgactcagtatctgagagaactgcccggaggagggtaattcagttctcttattatactgggtgcattttaaagaaacatttcttacatgcaagaaccacactacccatatccttgagggatttagagatagaaaagcaccatttccaactagcaaaagactctcagaagtaaataatctgtgttccaccagaactcatatatagggagggaagcttttagttatctccaagcactggagaagtgaattaaaaccatcaggctgattcctgaaacaaaaattcatcattcaaaaaagatgtagaatcagccaggtaaagtatgaaaggctggggggctggagatcagaaagggcaacacctgcatcattcaccatccacatggcaaaggcatgaggacaaagtcatagcccacagggaggtctctgagcatgcacagccggccactgaaaggcacatgaaaaggattcagttatggcgagatgctgactccgcgcatgatctcttgaaaaggaagcaaagaaccttggggagaaagcattgacagggagaggaagtacctgtggaggcctcagcagagagtactggtgttctatagccccggatcaccccatagatggagactctataaggcgtggcagcctcgaggcccgggatgtccacagccctgaggctgccaggcaacgtgaggttctgggctgcctccactttgttgacctcctgcacctgaatgacaaagtgctcataggcattgtcagctgcggtccagttgagtctgaggccatcccagccaacctcagacacggctaaatctcccagctgtgggagatcctctgaagaaggacagaaaagtatttgtcagttctataaaccaaaaatgaggaaaccaaacatcccacagcccaactctaggaaagagagaaaggggaaagataatttttttttttaattcttggtctctgagcatttgcaatttgaactgtggttccctggccacagttgtcttcaggagttgaaaatggccagaaagggaaatatctacatggtttatccttgagatggcaaagacatctgcaccaatgcacaacccaccgggagcatgcattgctagcaggtgaaattcacatggaaaagtaggattgtgggttagggtaagagatacagcaatggttacaagtgcagaatttggaggcaagtagtccttgattagaatcccaatactagcatttgctagctgcataatcttgggcatgtcactcagcttctctctgagccaccctctctttacctttaaatggagttgatggtactgtttcatgggattgcgtgatgattaaatggtaatatttatcaacttcttagtatcatacctgatacatggcgagtgcccaataagtgtcagcttaataaagaaatcattgttcaagtgttttcccttggaatttcttactcatgtcagggagaaatccctgctttatttcattatttataattagaaagattatctcatcactagccactggctacctgcctgggttgataaagtgtatgctgtctcaggtgtgaacaagtatgatgttttttctttggtcttctatcagctttcagggatcaaaagttgtgtactgggttctcagcttgtttcttcttccacctttttctgctcgtactttatgtctaaaggaagaatggctgtatcacagagcaaagctgtttgtgtgaaatgagtgtgcctacttttaattaaaagaaaggagatttttctcagtaaatggtgcagaacagaacccactattactgcttctacaatgtagaaaggaaatttaacgtagttgttattggtgatttagaaagtttggatttaggatatggaaaaacccattgttttgtgggatgcttctgagggttaaatgcagtctctcagccactgttttgaaggctgaagtggccatgggttagaagttagggaggagaatatctgcagggatttcaaccaaaaatagttgaaagatatagatacttgctcttgggtatccaaggattcaatgccctgtgagagtctgagcaacctctgagcaacctcttgcttttaagaggggttattttcaaactgtgttccacatagatctggggcttttctagaagaactgtgttgagaacatgggtggaggtatccccctcttacttccaggcacaccaagaacagctgttcacttatctgtcaaatagtagggttccttggaagatttcatttgcaaaaggagttgtactgctaaaaacaaaagtttgcggactacagaggaagatatgagcatcttgcacacagaccacacctgtctcaaaggccctttttgctcttgtttgatctgaagatattccaggcaacacaggaataaaacctggcccccttatttttggaattttatgtagtttctagcaaccaccaagtttatctgttatataagagcaaggaaaacaattgttttgaattgagtgatttggattgcattatcaaaaggcagcatatgtagagtggggcatgggcttagggctcagcacagaaaccctatcaccaaaaagttggccctttttcccatagccctttttgaagctatttctagaaatctcatgtacagcacagttttttataacagatggagcagctcatttttggtggaaaattgagaggaattgtttttccttcccaaattgaatgaaaagcattgaagtcaaaggtggctgtcctttcttggaaatgtccctgctttttgtatctgttgaggagagagtcctagatagtttcagcagaagctaactgcatcatttctaaaggttattatgtagagatctgcctatcaggtgggtgttagttggtggctctgaggctagtaataaggtttttctagaaagttctgatcttatttttgtgccacagccctaacgtttgtgctattttaaaaatcatgactctgttgctgtatgataaatttagctatttgctattcagtatttactacgtgatgggcgctttactaagcactgacattcattaacttatttattgctcacgacagtttcctgaagtagggttcattgctgatttaaagatacaaaaaggaggctcagggatgtaaagaaatatacccaagaatagaggtagggcacgctggctcatgcctgtaatcccagcactttgggaggccaaggtgagaagatggcttgagcccgggagtttgagaccaggctgggcaaaatggtgaaactccatctctacaaaaaatacaaaaaacttagctgagtgtggtggctcacacctgtggttccagctactgtagaggctgaggcaggagaatcacttgagtctaggagttcgaggctgcagtgagccatggtcacaccattgcattctagcctgggcaaaagaatgagaccctgactcaaaaaaaaaaaaaaaagtatatatctatatatacacacacacatatatatatatacacacacacactatatatataagtatatatttgtgtgtgtgtatatatgtgtatctatatatatacatacacatatagtcccaagaatatttagctagtgaggtggaattccaacacagaccttcctgagttagagattcacgctgtctgtcaacaacattggggtaggattctgccacacgggtgaattttctctatttcaatgacatgctggctcctatcatgtctccagtctgggaggagggtcatatacctgtgacgacctctacagcaaggggtcgagtgctgtggcccctgacctcgccgtgcagggtgactgtgtaaggagtgccagccctgaggcctgggatttccatggaacgcaggctgccaggaaccgtgagattgtgagcctcttccacctggtcagcctcctggacctgaatagtaaactggtcataggttccatctggcgtggtccagttcagtctgagagcatcccagctaacctcggtcactgtgaggtttcccatatctggaacctcctctgcataaggacacagagttgctgagttacttaaaaaggcaattgcacgctgggattcaggtgagatggcattttggctaaggttgggatgagttgtctggttagtgttgattatagatgcatgatttacagcaggtgttgagcacactcaaactgttggcactaaagccagggtttttctattcagcttttgggaatgaaaagtagttttaggaattgttcacaatttctattcttgacatacaaatagggctatggggagtcctttggtgttcttaaaatgagctcatgagctcagagctattttttcttcatttacaggttgggctttccaactttttagatattgtgactgaaacttactttgaaagaaaagccacctctcacttttttaaaggaggagtaggtggaattttccatggaactgggctacaactaggacttagccaaataagggatgtgacatttaggaagaagcagagatgattcactggtatttccccaatgtggtaggagctgatcccagtttaaagcaagaaagtgctttgattcctcccgagcagagacaaaggggaggaagtgaattagtgaattcgtctagaatacctgtcaagacttcaacagagagaggggttgtgctgaagtcctgagtgaccccgcggatggtgatggtataatgagtggctgctttgagcccaggcaggtctgtggacctcagtcctcctgggacggtgaggttctgggctgcctctactgtgtcagcctcctgcacctgaatgaaaaagtactcataggccccttctggagcagtccagttgagtttgagggcatcccagcccacctcggccaccacgacctctcccaaattgggagtttcccctggagaaggacaaagaactagtttagtgatcaaatcacacaacaagatccagggaatctttaacacaagaataagctgaataataatattactgaaaaaatgtgactttctttagataaacatgcatcatgcaactctttaaattttagaaatggagcaaagagaggaaagtgcaggaaaatatttgtttttgtttgttttttaaatcttaaagaattgccttaaccctcagtagatgagagaattttgtgattttctttccctttcatatatagtgccttaacgtcctttaacaggagggaggctgtttatggagctaaaggccctctgcatgggagctgtgtgtttagtcctgcaggttgagctctgtacaactcccaagggtgtcattcatgtggagtgaagtattaaaagttgccttggggttctgtagcgtgatggcctcgtgtcacaattagaccccatagacataagtagtggcagaacaagtccattccaaagctagtcgtgtctgattattcatgggcagtttcctgctgggaaaaacagaagctataaatagaaaggaaagagatacctgtggaggcctcagcagagagcactggtgttctatagccctggatcaccccatagatggagactgtataaggcgtagcagccttgaggcccggtatgtccacagcccgaaggctgccaggcacggtgaggttccgagctgcctccaccttgttggcctcctgcacctgaatgataaagtgctcataggcctggtcagctgcggtccagttgagtctgaggccatcccagccaacctcagtcacggtgaggttttccagctcaggggcttgttctgaataatgacagagatggggtcagttaaactattcctcagaaagttttgcttctgagaacctgggaatggcaaacccaatgccacatctataggccattgcagtccaagtgccaggctttgttcactgcatcccctactggtgctgtccctattaaaacaccagcaggacaacaatgtcatatttcttttgtggccgggcatggtggctcgagcctgtaatcccagcgctttgggaggccaaggtgggtggatcatttgaggtcaggggttcgagaccagcctggccaacatggtgaaaccctgtctctactaaaaatacaaaaattagccaggcgtgttggtgggcacctgtaatcccagctactcaggaggctgaggcaggagaatcgcttgaacacagaaggtggaggttgcagtgagctgagatggcgccattgcactccagtctgggggatagagtgagactctgtctcaaaacaaacaaacaaaaaatttcttttgccttcatgcatatttgggtttttctcttggaaatggtattttcctattgatcagtgtcctgcagatttagaaaactatatgtctatgttagcgatgctctgagcttcagttttcattttggaacatgtcttgcatcataatggggtggccctcagttattctgggggtcttggtttgagctgtccgaccttctgtattttgagacaattggctcttcttagatacccttcttttttgagaggccaaggtgggcagatcatatgaggtcagcagttcaagaccagcctggacaacatggcgaaaccccgtgtctacaaaaaatacagaaattagctgggtgtggtggcgtgagcctgtaatcccagctacttgggaggctgagttaggagaatcgcttgagccctggaggttgaggttgcagtgagccaagattgagtcattgcactctagcctgggtgacagaacgagactccatctcaaaaaaaaaaaaaaaaaaaaaaagcctcttcttttttgtgctgcctcaatatcctatgggaggtctgttgtatagtttatattgggatttcatcagtttctagcgttcaaatcatttacatagatcatattagtaaagatcagagacacattgacacagtattattaaggctgagctaaggaaggtgataaggctttgaaaaactgttccttaatagaaaaaagaaagaggtcctgggagaagcagatcttatgaagctcaagtaaaactgaatgcaccctgttcattcatctcgcgaatgcacgaaattccgtaaaaactcactggtctcaacctgacttaagggagataatttgcccagggctgagcttaagtggactttgcatagtttaggaaggaaagtatttctctggaaatggatcctgtaaactagagagtagaaactgactttaaatcatttaaaagaacaaactgtttttttctatttatacttcacattgctgctaatttcaaatgagccttatgtgtccattagagcaggctactaagttgaaaatcttagcttggaatttgattgaggatatcctttcagaggagaaaacatttcttttctggaattgatttaactcagacatttctaagttctggggaacattcttcctgcttgtttcatattgtcagagcatacactccttcaaattttgtttgatcgagaacagaggtccgcaaactgttacccgaggcccacatctggccagctgcttattttggtagtcagcaagctaacaacagtttttcttacttttttacatggtcgggaaataaatccaaagaagaatattatttcatggtgcatgcaagtcatataaaattccaattctggtgccacagataaagttttattggagcatagccatgcttgttcacttatatattgttgatggctgcttttgtgttacaaaatgtgcagttgaataattgtaatggaaactctctggcctataaagtctaaaatatttaccatctggccctttacagaaaatgtttgcaatacttgatcttgaatacagactcctctttaaccccgactcatatcctaaagcttacaccagaggctccaaagcagttcttaaccacctaaacatggtctttatgagaaagggaggaccccaaactgcaagtgatgtatctagatttaggaaaagaaaggaggtgtcaactacctttaatcctgctgggccttgtgaggccagaaacagttccctggatatagtgattatacccttgacattgggatttaagcacaactaaactcaagagcatgtccttctcaaatatttcagcagtcctgatacagaaagagatataggacaaaaacagagctaagtgaaaattaaatcaaccctatgtcttcttagctctccttcttatcccactttcctgtttttgtttctctgctgtccacctgtcaggaactaatctgtcattgacaacgtaccccttcgtgtgaattaagttactgtcttttttctacgggtgtctatcttttaatccttatgtctaattgttacataaaacatttttttctataaaataaattttaaatgcccccttgaaagagatattgggaaagttaccttacggggggtgggggaatgagattgtggattgcccattaagctgtggcaaaagatggatggagagaaaagatgcacgttggaaaatgtctcttcctaatgagaatcatcttatctctttgaatcggatatttagtatgccactgatactttcatctaattgtccccacatcctgtttcatctgttcatatagttgatagagtgattttttttttacataatgtcatgttgttcagtaaatagtaatagtgatggtgttggtacttctgctaacacttttggctatttctctactattttttttttttggtaggcaaatcaagaaagagcattggtttataactcagagaggcagtactgtggccatgtcagtagtggatgctacgtgtgccccatccagatccctttattaaataaatgctagccaagtgagtaaaaggtacaacttccacaaataaaatcagtagctaaattaaagagagagggggtcagaattatgaaagaagggggaatattatgaataaaaaatacagtggacaatagttgagatgaggaccaagaggcttcacataaatgctggctccacatttcaactgcaaatgacatactgtggacttactgccctagaagccaagtgtttccattatagattccacactgaatttcttggcatttctttatcaaaaggctgttgtcttcttcttacagctgtgcactggaatctacccttgaacaatgtcagtgggcctgggaaatcagaattttgaaacccattgctgtgctcctggtgggttgagcagctggtctggaggaatttctgacagtgccaacttaaaaatctgtagattgttaccatcttctagatagtgattaccaagtgctggcttgatgaggaactcacttcagcgtccacttaggggagaaagagtgattctcccacagcaggggcatggtcacatccaagcctgacaaccccaaagggtatcttcagtcgctttactctcatctctcagagataagacaattgaaatgagaagccttggctgccttaaaacattcggtgatttctttgtaactgccaagaaccaagcccctttgcagatgcccctgatgatgtctctagcctcctaccctactgttttcccactctatcatatagcaggactgtatagcttgcagttcactaaggtaaagtttctcatgcttttcagcttttcagatgctattccctttgctggaaatgtcattactctttctccacttgcccagccccttttctttttcagaactcaaccaaacatcacttcttccaaaaagccttctccagtgcttttcattccctttgcttaggtctgtgatgggtacctgtctgtatgctcctgcagcctcccacaaatccctctaaaacagataagctacagtgttataatttgggttttggttctctctcttatagcaacgtgcaccatttcttgagaagagaagctgtttctttctcttctatacaccggcatcgcctgacccacagtaggtatgaaataaatatttgctggatgaataaatatttgaataaatttcagtttggtctgtgagaaaatcaaaatagcaaataagagcagaatgttctgtattactggtagctgtggctaaaaacaaaattccacctttcttcttccaaaattcctgagagctactgggttgtcactgtcaaggcttatgttgctatgaaaatatgctttgctggctttatgtttctgcctatcacccctgcctcctgtctcttatggcatgcagcaaattcatggctttgaccttaagcagggtttagttgggtttataagagtacaaaagcagagagaaaagggagagagaggagaggagagagaagaggggagaagagaggaaggagaggggaggagaatagagtggaggagagggaaagagaagggagggaatgggagaggaggagagggaatgatgcctggtacacactaatttttttaaatgccaacagacacggtacctttcgttcttccctcctcccttctttccttcccttcctccctccctccctccctctctccctccctccctccctcccttcctccctccctccctccctccctcccttcctccctccctccctccctccctccctccctccctcccttccttccttccttccttcctcccttcctccctccctccctccctccctccctccctccctccctcccttccttccttccttccttccttcctcccttcctccctccctccctcccttccttcctcccttccttccttctttccttccttccttccttttctatccagattaagcggaattgaagactttccaagggaatgatttcccttatgccttaaggaaagaattggggtgttaatgcagaggtggaagggaagaatcagaagattctatggaaatgctgactctgaagtagccagggtccctaaacactcatgaagctcataccacatacttgtctgccttcagggcactgggattcagcagtggatgatggaatcagtccttatattctgctcactgatggggaggcaggccatagatattatagtaaaccaatacttgcataatatcaaggcagataagtttcacaaggaaacctagagcagcttgaaggggtagatcaggatgggggtgcctttttaggctggtagtcagagaagccctctgttctgggtcatatctgagctgctgagtgaaatgagggagcacgctctgtgaagtgctgggaaaagagtggtatccagggagtgggagcagcacactccaaagcccgagggtgggagcaggctcagaaagcttaaggaacagtgtgaaggcccaagaggccatggtgaagtgagcaagggaatgagtggcaggactgaggtcagaggatgggctggccgtgccagattctgtagggccctgtaacccatggctgggtctttgggcgagaggtgtgataggtggccaggttatgcatatttttagtatggtgccacatcaagaaaaagacttacattatggcccaatccatcagtaaaaccctggaattccccaggaaaaattcttcagggccactgattcttcatttttctctgtaagccccacagacattgagtggcgcctggcaggcttctgctattaagaatccagtgatacagagctggaaggttcttgcttctgatggttgaacctaaaactctgcaacatttcaggacttatagccacatggctccttcacccaagagctctcgcttttcctgttttctttcttcctctatgcttaccaaggtcaggtgcctgggcttctacttctttagctattccatttaacacatctatgtttgcctcttatgtctctgtccaaaagcgtcttcccattgtaagcctttcctgattctctgaagttagatccagtgtctcctgagcactggctgcaccctctgtaccctcgatcgtagtgagcagaatgttatctcagtgtctgtttgttcgctacacagtgagttccttggaattaaatacccgtcttctttgctctagtaaccccagaacttagcacagagcatggtgatagtattttattgactgagtgaatgcagaaggctttaaaagttagaattcaaggagggaaagaagcgtctgcttcaccttaaatgaaacatatatattttttcctgtggagaaagggatgggggaaatagtctgtggacagtggagaagaaccaataaaaagaactttgcacatttttcccacactgaagaatgtctttaaatacgaaacatgatatctttgaaatggcattaaggaggcgtggtggggaaatgcaactgctgaggctttggaatgccaatatggggctctcattcagaaacagaataattctagctagtaaatctcctggttatagccacattacctcctttctctagtggagaagccccacacctcaggatcttagggagataaaacttcttcagtgactgcgcaggtgtgaggttttctcactggaggaaggaggcaatgtggccatcaccagaaggtggaatgattgaggggcaataggaatctctcttagatacagcatttatcaaactcaagggaaagctaagggagaggggcagaggaaggaggaggaggaagaagagcaggagtgagggaagagggaagaaagagagagaaagagaaagaaaagagagggatttcatcttttgggcatttctgattcatttgttgccccttgacactttataacaagctcatgtttataaagctgaaatttaaatctctactatagatttatttcttcttggttctatccccgccccccaccttattttttaattaaactattctttcagagcatcctttataaacatcttatagttgggtgggaagcagtcaatgcagagtcaacagaattgaccacgtaaactcatttcagactctggcagggactgctcattgtctgccaaatttctctcttacaaatgacctcaattttatgtggaagtaacatgttcagacagaagactacctttccctgcctcccttacagctaggagtggccaatgaactatggggagaagtgattggtggggtttccagaaagactcacccagaaggtgctcctctttgggagttttggttcttcctcccttatgctgcctagaacacagatggaatggctgtattacagcagccatgttgtgacactgagatgactttgagaatggaagccaaggactaaaaatggtggaaaagaaagaagcagcctgggtgcctgacaatttgaaactactaagttatccctgtacctcccagctccagattcattttataagaaagaaaaccaacttctatcttaagtaagtgactgtgatttgagactgaagatattgtgagaaagactcttcaagccatttccaaatatgtccacacttctaacccttttcttgcatatcaagcttcaactggaataacatcccttgccataacacctttgccagctctcctgatttccttggatcactctttttctcgagttctgtctagcattctgagtatctagtcttccgcaagcactatgagcaggcacaaatgagtccacataacaatgctgactttgggaactacttttcctcaaatatcagtacggtacaatgtatgcagtaggtactcaatacatgcttactaattaaattggaagtaaagactattacttgccaaaccctggaaaagtaacattttccacctatacatttcgaatatttggtggccaaaattgaataggcttatttttcataaaggaagaaatattttaaaaacctggttgtctcttcagtttagccaccgagtaaccatggcctcaggttcagtgaacaggttgcatgggccagaatggacacaagttgcatgggccacaatgtcaggattaagctgtcgtcatagacaaactaggttaatgtcttaatgactaagagaaaagagaaaatgagagggcaccatggaagtctcaaagggccgtgtgccactcttcaggggtaaccttggcagaaagcaaaagacctggaataaaaacagtttgtagaaaataacaacaacaaaaaaaatattattaccaacatcttggtcatctttaaatgaagtaaaatgaaaagtaaattaattattaggctaaaagaaggaaataaacaagaaacaattgaaaagatgctgtgatgcacagttaagaaaagaaaacaaaaatcataggtaaatgcaaacacaaaccctgatgtttaaagttctcctaggaagaaatattttaaaacccctatttcccagtgggggaaatttgctgtatcagttgacaggaggtagaaaagacgagtaagcagccctttcaaagtggtgttcaggggcttcagagatggagaaagtggcttgcttttgcatttggctttctcatgtgaggacaccctggctgaggagatctgctaacctcagaatcaacctagagtttggaggaagctcagggcagactcaccagtggatgccttcacacgtgcgggcttgctcttgtgtctgcctttctcggctgtcaggaggacattgtactcctgtcctggttccaggcctctcaggacataggaagtggtgtttcttggaagctgcactcccacccactggcctgtggggagactgtaattgaggcggtagcggtcaaatttggccaacggtgtcttccagagcagggtcaggctggtctctgcagtttcagaaacctgaaggtccttgggcgtgtccaactctgggaggagaacagagagatgaatgctcttcaggctgcaagacagggctgcttctggggctgaaagtcaactgcatctgggctggaatcctaggtctgccacagaggagctgagggaccacaggagagtcacatctctgggtctctctttttacttttgtaaaataggtctaattatacatcacccacatgaccccatcggagtctgagaagattgaaaataatgtcatggaatatccattccataaaatgctgctcagatttaaagcagttaaaaggaaccaactattgataaaagaagcaatttagatgaatctcgagagaattatgctgaaggaaaaaaagccagtttcaaaatgttacatgctgtattgctatgcactgaatgtctgtgcctctctaaagttcttatgttgaaacctaatccccaatgtgaagacatttggatctagggacctttgggaggcctcatgaatgggagtggtgcccttataaaagagaccttgccccttctgtcctgtgaggacacagtaaaaagatggcctgctgtcagccagaaagcaggccttcatcagacaccaaatctgctggcatcttgatcttggacttcgcagccttcagaactgtgagaaataaatttcttctgtttataagttacttggtctaaggtattcttattcttgttacagtaactcaaatggactaatatgtgtaggatcccatttatgcagcattccttgaaatggcaaaatcatagagatgaagaacagataaatgaatgcccagggttaggcagaggggcaaagggagggaggtggctgtggctgcaaagggtagcatgtgggattcttgtagtaagactgttctgtatcttgactctagtggtgcattcacaaatctacatgtgtgataaaattgcatagaactaagtatatacacacacatacgaatgagtgtatgcaaaactggtgaaatataaatagagtggacagattacgccaatgtcaatttctcagttgttatattagtctacatttatgcaagacgctacccttgggggaacctgggtgatgggcacaggggatctgtctgtatgctttctcacaattgcatgtgaatctacaattatctcaaaatcaaaagattaaaaaaaaagaattggcatgtaaatgtccggccttgcatcccgcataatgtggaagctcaatgatgatccatctcctctttacacactagcctccttcttcctcatagtgcctgtggggaggtaagctgggggctgggggagaggcagaggaggagttttctttttgcagtgcaaacttcccagaaaaatggaaaaaaaaatcttgaggaaagaatcaatgacctcaaatcaggtagcccctcagcatcctcacctacaagctgcggctacaggatacaacaggtaagtgcagggcctggacttaaactacaatcctgttacttataatctgcttgacaggggtataaaagttaggtgttttctcagagaaaaccccacagttgtgtttggactagataatggtttatttaaaagatgcaactgattaccaacttacacatgttcatgaatttcttacaaagcctggttccaatttttctttaaaaaatcccggctggacatagtgactcacacctgtaatcccagcactttgggaggccgaggtgggcggatcatgaggtcaagagattgagaccatcctggccaacatggtgaaaccccatttctactaaaaatacaaaaattagctgggcgtggtggtatgcacctgtagtcccagctactcgggaggctgaggcaggagaatctcttgaaccctggaggcggaggttgcagtgagctgagatcatgccactacactccagcctggtggcagagcgatactccatctcaacaacaacaacaacaacaaacacaaaatccccagtccccttttccatacaggggatgatgttggcatcatacagatggaccgtacttatgttccttttgaatttcaacattggggctagatggtactacagggccctttttcctccaggcttctactttttctctttaaataggttttggccacattgactctgtctcatctgcccagcaccagctcagtgggatgggaattccaggtgtgccccacctgtggctgcgttgatggtcgctggattgctctccttgtcttccttcacagcagaaactccaatcccatattcagttcccggcctcagacctaaggagagaatgtgcaagttgagattcatcctgaaatcagagagactttcagaggatgataaaaatggctttgagttggtctctggaggctacaacaaattttcggaatgttttacaaaagaactcactgcaatccaataagcagtatttcaggaaattggacttatttctgagggttgcaaatggggacatgtgggagcaggtgcccatcctttaagggccctctagggctggctggctcaggcttgcagagatgcagagctcacctgtgagtgtggttttggttgtggcttgttggctctttggaacatcaacctcagcgtggtcccctccagagatgggggcatacttaattctgtaactgtcaatagctgccttgccattcctccattccagggtgatgctgttatctgtctgggaaacacgtcgaagattcctgggagcatcgaggcctgtttgagagaaggaacatttgtattgaacatatcagtcacaagagagcaggagtctttgacagctcaagctgacatatgaaacgtgcctggaactggagagaaattacaaaattctcagcacactcatctgtccccatagtggatgtgcaaatctaaacaagtgctacagatttggcacctttccctattatggatgagtgcgacactttagtcatttgtgtttttctcagactttgtggttaaagaaacaatgcaaagacttaaaaataagctcatgagtgtaaaaactggtcttttgcattttctcatcatatttcattctttattttatttttttgagacaagagtctcgctctgtcaccaggctggagtgtgttggtgcgatctcggctcactgcaacccctgcttcccaggttcaagtgattctcctgcctcagcctcccgagtacctgggattgcaggagcacaccaccacgcccagttatttatttatttttttgagacggagtctcgctcttcacccaggttggaatgcagtggtgcgatctcggctcactgcaagctccacctcctgggttcatgccattctcctgcctcagcctgtagctgggactacaggcacccgccaccacgcctggctaattttttttgtatttttagtagagacggggtttcactgtgttagccagaatggtctcaatctcctgacctcgtgattcgcccgccttggcctcccaaagtgctgggattacaggcgtgagccactgcgcctgaccccaatttttgtacttttagtagagacagggttttgccatgttggccaggatggtctccatctcttgacctcatgatctgcctgcatcagcctgccaagtgctgggattacaggcgtgagccaccacgcccggcctcctcatcatatttctaataactcacaaagtacttactgagctctgaaaaatatttactgaatgaaaaattgacacttttgaacttttaaaataatgccgtaggctaaagtgttaggaggctcatttgtcatatatgttttccatataccatattttactttaaaaatatttatttgaactttattttaaccagaacttttgtctgagaatatcagaccagcatcttctacatatgtcccccacccccaaaagtgctttggaaggttatttggaattttttttgaaaaattaattaataaattgctacaatattttaaaatttacaggagtagaaatacccctttcatttttcgtactgtaaaatgagcctggaagataccccaacatggagtgggatggaaatctttcaatctttcctttactatatctgttaacagggggaggccttttacctgttgtgaaggtctctttggctgggttgcttgacatgtcacctctgcgggagatgagggacacctcgtactcagtgtcaggcttcaggttcccgatggagtactggttctcgtcctctgtgagatcgatggtggtacggtctcctggcacgtctttgatgccgtaggtcagctcaatgccatcgatctcagccaggggcttgaaccaggtgatcaaggcagtggtgtctgtgacatctttcacctcgatctggctgggggcatccaagcctatgatgggcagaggacagagaggcttcagaggttagggccattgcctgaggcttagcagagagaggactttgtaactctccagacctgtgggtgaatacttatactaactgcttgactttactttgcctttctgaaccttagtttttggtttgataagctataagtagggataacagcagctacctctagtgttttttgtttttgtttttttcaaatcttaagagagataaagcttgcaaagcatctagcacagagactggcccatggatgtcacatgaaaaaaaaaaaggttgttcttttgttattattattattattactgttctcataagttgaggaaacatgctttggggatactttatttgaaaagatgaacttagtctctttaaatttttaattaggcaaaacttcctggatgtttcctgaaaacttttccatcagaattaccaagcagaaaagtgaggcaatagactgtcttgacagtgtatggaaacttatttttgatagaaagaattcacgcaagaaagtcattgctatttcaagccttgcctgtttttgcaggctcatcttgactttttctgccccacctactctggtgttgtactctgatagatgctcagagctctggaagcacattatgctgttgggcaccgcctggtctctgtacatgctgttctctcatttcttctttctaagatcatacttccctctaaaaatctcctatgcatccttcaaaatcccacttaaatgttgtctcctaatgagaagcctttttttaacccggcttcagtcaggtaaacacatattccctccctgtggctgccactgtccttgaagagcattctaatatcatacgtgtctcattgtttcataacagatttctgtacagtttgagtcaatttaggtagggttattcattgattgagagagtgagtcttttaaattcccagcagagacaggcatattctgggtattcagtgaatctttgaatctttctttcttcttcttctcctttttttttttttaaatgtgttttcagcattggttcagtaaacaataacaagtgacaggaagtgggctttatacagggaatgaaaaggaacaataatttacagcagattgtgagaaaactgcagagtctgtttttgaagtctaggtgttgacacatcagtcccagctcacagatgatgtaaaatgcacaatgaaaatgatgtcgcaaaaatggacagaagctgcctgctctgtgttcttataggtgctagcaagcacccaaaccgtacctactaccttccttagtaccccttgcattaaagaagttgggtttccgtcaaggacactgatatccccctagatttgggacccttgaatagcagaaactaacaatgctctgtatttatcaggtgcaaagatggtgctttgttatttatgtcttgagtcttatgacgaccccacaaggagaatactataaacccatttttcagctgttggatctggagcttaaagaaatagatttttccaaggtgatggtgaatggtaaagatggaattcaaactcagaactgattgaatccaaagcccatccttttccccctttacatgacaacacctctcaaacatattgacctcaaaagtaagtataataccacctttatatagatgccagacagaaggagccaaatgtgttctgaactagaagtttaaggccctttacatctggaaaaaaggttaaaggtttaaaggtttcaggtatatgtggtaaattgtggccggccgtggcggctcatgcctgtaatgccagcaccttaggaggccgaggcgggtggatcacttgagatcaggagttcaaaaccagcctggccaacatggtgaaatcctgtctctactaaaaatacaaaatgaacaggtaaatatttgtccccctatgttgaaatttatgattatgcaacttcaaatgttggaatgtttgttctaaaataagaagaaataaagcagacaattcccaaatttagataaacaaaagagcagtgaaaaaaaaagttcagtgcacctcctccatagcaactaagcatttgctttgtcttttctttgtctttctggtgatctaatgatttttttttcctgttggtacctgcttttctacctaccacagagaggtggtgtcaggatgatggaaaacacttgcttatgaaagagaaaatcctttgaattggctctgagctaggcaaaatgtgcaaatatttaaatgcaagatgttctttcttgtcattagcaactgatttaatttttccaacaaccccctgccaagaagagtcgattacttaaagagttggcgcatatgttatcttgaagaaaataaagaggttttcctatatggaagtgcaaaattatgcatttttttctttttaaaaaattgcagctgtgcacggtggctcacgcctgtaatcctagcactttaggaggccgaggcgggtggatcacttgaggtcaggagttggaaaccagcctggccaacatgctgaaaccccatctctactaaaatacaaaaaaattagccagatgtggtggtgggagcctgtaatcccagctacttgggagactaaggcaggagaatcacttgaacctgggaggcagagattgcagtgaactgagatcgttccactgcactccagcctgggtgacagaaaaaaaaaaaaaaaatgtttcctggtggagcaactccaaattcaggtctttttctcaccaaatgatctagtactgctaaatcctattctactcccaagaacttctgacatcattagtattgaatgaaattttatttaggttcccattgaagagatggaatcaacattctacataaaccagagcctagtcaatgttagtggaaatggggttaaagttataaaacttaccctggcttaaagttatgcccctgatggtgttaactatgggatgttaaagtgatttagcttctttaagccttaacattaatattttcccttcctctgtcctacaactgggtgctaatattaaactagtgacatgatgctaattagattgttagcaatgggcttaattatcttcaggtagtcacacccctttgaaaggagattttgaaactcctttcatcaagagatggatctgtttctctattccttaaatataaactggccgtgggatgtgctttgatagaagtgatctaatgccaattttgaacctgttcaatagctgtgtgaacaggaccagcatcctggagaatgagaggctctgcgaaacagaaagacaccatcctggctgaggccatcctaggccaatccaccccttaagcacacagatacatgaggagtgcagtcaagaacagataagctgctcagctgagcccaaacccaaatcaccaacatgcaaagaattgttattttaaaccactgtatctggatttttaaaaatgcagcaaaagttaaatgatgtagatgctatatgagaaggcactttctcaaccaggaggtgctatgaggtacaatcagccttatcattctataagtattaaaggtgatactcacgtgtggtggtcaccctcttcaggccagggccccgggtattgtttttcactatgtgcagagatatctcatactcttgcccaggagctagaccagtttgccggtaagaggtctctggcctcctcaggcttttggtgatctctccctcatcttctttattctgagagatagaggcagcttggtaagagttaggggaggtgccagtctcttaatttatgtgattcattcactctgcattcattcattcctctgttattctttcatcgattcattaggcacttactatgcatcagatcagtatgtaagctactgaggatacagagatgataaagacatttctctagtttgtttctcccattcgtaaacttttacccctttgtcatgcaagtcaaatgacagaatgtgagagccaaaggaattctgaaggcacaagctcaatccctccttgggtagactgaggccagcatcagaggagtagggtgattgttggatagtcacacagctggttggtggcagagcctgggcttaaattcagagaacaagttccctgcttcacatgtacttttgggcctggagagaagggttgctcaaatctgagatgtacctttattttgagggagagactgtttcttctcttctttgcctctgagtagagatttctaaggtgatgatggacaattggaaccttgaggtgacaacttctatttgtctagggtgtcagccgtaagtgctacacttacttattaaaatcagggaaaaaccaacatcccttaaaatatagatgcaaacacaaatgatgctaatgagagccttgtcctccaccaaaaactaaggaaaattagttgatacagaagtcttcagaaccctttggtcatctttcaaatccttgagatcaaatggatctgctcttttgtactccttaccatattccggaagatgatctcccaggtttcaaaagcaatgtctagaggatcccactccacttccacagatgtctccttgatggacttgaatttcaggccttcaggtgcaggtaagtctgtaagtaacaacataaatagaacgtaaggatagggcaggtgtgtgattgggcaacgcggccacgattccactaaaccagactggatgtctgcaacagtcaggggctgacaaccagagcaggtgtccttttaaagcttcttctgggatgaggtctctatgaggctgtataaaaattaatattaggaaaaatggtatgattaattttggcaatttcatatgtttaaatctaaaatgaacgcaggctttggaatcagacagacttggggttagaatctaagctctactatcaatgtgaacttgagcaattgcacacagtgctctaagcctgagtttcttcacttggaaaaagaaggtaaatatgtctacttcttgggaatgcattgaggagtgagtgatatactccactccagtgtgtagactgctgggcctggttcgtggcatgcagaacaagttgaataaatggcagccaatgttattattaaggaaaaaagggtcaatttctagccagagcttgctttttagatatgaaggtaattatactgatgctaaactcataaaccagaatgtttccacttaaagaaaaatagtcagtgatctccactgaaaagtaatagagtggtttagaacataaacctgccaggactgccagggttaaagttttgcctctactccttgttagctgcatgacttgggataagatgcttaaccatgcagtctcagtttcctcatctgtaaaatggggttaacaatagctcctatttcatacatatactaactcatataatgaggactcttttttttttttttttttcttgagacagagtctcaatctgtcacccaggctggagtacagtggcatgatctcagctcactacaaactctgcctcctggtttcaagctattctctgcctcagcctcctgagtagccgggattacaggcatgcaccaccaggcccgactaatttttgtatttttagtagagacagggtttcgccatgctggccaggctggtcttgaactcgtgaccccaggtgatccacctactttggcctcccaaagtgctaggattacgggcatgagccaccatgcccggccaaatgaggactcttatactaatatgtagactgcttacaacaaagtctgatacacagtaaacacttgctaaatgttacttgtaatgattttctctggcaggaagtatataggagagcaaggagaaagatttgatggaaaatgagggatttctttaataagtgattctatggacttaattctaggctcttatttggtataactgtaaagaacaactataggattgtaggggccgtggcgagggagggttatacactgggtgggctgacatcaggtgaggctgcccaaaagagttctgctcactcacacgtggccaccctggcgctgacaggaatgctcttcttgttctccaggatggcaaatacacggataaagtactccacaccaggctccagctcctggatgatggtggacgtctggtccccaggcacacggaactgcatttccagaccaccctcgtgggtgggcgtgtacacgacaaggtactctgtgacccgcatctcattgtcccaggccaggttgaccgtctcttccgtcacttctgtcacaacgaggtctttgggaggagacactggcaggaataagaaaggacatctggtgtcaacagtgtgtcctctaaaatctctctaggtttgtttgacctgtcttttccactgtcagccacagaggtctgaagatcttctgttgcctctaaaatgcagatggcatcagggaccccctgctgtgatccatcttaagacctgtggtggctgttccttagtccatttccttcaggctggagtcccaggtcagcagtgtgcccttgggtgtttctggcctctccaactttctgtgcttcctgggtcttagctcagatgcaggctgttggcatgggaaagtgcagtctgagcctcactccctgctctgaactttgagttacgtgtccctagcactgggagggtattttgggcatatctggtccaactttcttatattatagaggtgagtaagacagaacgccttgaccaagcttgctcacctcatcaagtttagaacttgtatctcctccctgccagcctggtgttctttccaaccaggcttccctgcttgcgccacattgaacacaaagccatttatttatgtttagataccaataactttagtaaaggaaaaaattctccattatgacaatgataatatgggtagatgagaggagtacaaagaagacactcattaaatatgagcattaattttctctcctgtgttttcacttaaccagggtttactaagcacttaatatgtaccaggtcccatactaactgctagaaatagtgcccttttaaggataggagcttgcagtctttaggattaaaaaaacaaaacaatcaaaaaaacaaaaccagttacaaaagacaatgaaaagacaggtcaatcttgtagataataggcatttcgtctttagccaagtatgcatttgaaacagttgtttttatgtaatctcactgcgtattcaatttagctgaatttttacatccatccaaatacagagattttgtttactgttggtttgatgtcagtggagagtaggaaataaagttgatatttagcaaaagagagagtatccctttatctacctcatcttgaacactagatgtgttctggcctctccaactttattttaaactctatgtagatgagttaggcagacttgaataccagctctgtgatgtgtcagctgtgtgtccctgggacaattatataacctctctgagcccttcagcccttaaataggtcaccttgtaacaacggaatgacagggcccccttaaaaagtcattatgggtgtgtgtttaaatggatatattaatacgtacaaagaatcagtgtgcatgaatgtttatatatataaacgtagttttccaacccatactaggagtccactccatcatggccattatatgctggtctgcgccctggcactcaccctctgagcagtcttctccgctgtagccctcgttgcagatgcagcggcccgagacgcattgtcctaagttgttgcagtcactggggcaggagtgctggccacagtccaggcctgtgaagccctcgtggcagatgcactggccgtccacgcagcggccctggccatgacagtcactgggacatctttgctccttgcagtctttgcccataaatccttcatggcacacgcactgcccattcacacagcgaccctggccatggcagtcatttggacaggagagttctgcacagtcagggccggtgaagccgtcctcacagacgcactgtccgtccacacagaggcccctgttgctgcagtccctggggcattggcgatcccggcagtcttcccctgtgtagccgtcatcacaaacacacatgccattcacacagcggccgtgctggtgacagtcattagggcagctcatgtcactgcagtcatagcccttgaagccttgctcacatacacatttgccctcgacacagcggccccgactgtgacagtcattggggcaccgtagctggctgcagtcctccccagtatagccctcatcacacacacactgcccattgacacagcggccatggccactgcagccattgggacacttgagctccccacagtcagctccagtgaaaccatcatcacactcacaccgcccgtctacacagcggccacgattgtgacagtcagcaggacacctcttctcgctgcagtccacaccggcaaagccctcatcacatacacactgcccctcctcacaccggccctgggtgtggcaggcatgtgggcaggtgggtttcccgcagtcttcacctgtgaagccttcttcgcagtagcaggtgccattgatgcagcggccccggtcgaagcagtcattggggcagatgagctcactgcagtcttcgcccgtgaaaccctcatcacacacgcactcattctccacgcatcgtccacggttgtagcaattgttgagacacagaggcttgttgcagtcatcgcctgcaaagccatcgtggcacacacacaagccatctacacatgtgccgtgctcctcactgcagggcactgggcagatttcacggctgcagtcagccccggcgtagccttcgaaacagatgcagactccatttacgcacttgccctggtcattgcagtcgctggggcaagccagctggctgcagtcctcgcccgtgaagccgtcgtcacagatgcactgcccatcaatgcaccggcctcgaaggtgacagttgcctggacattcgggctcagagcagttggggcctttccagccaggttcgcagacacagccacatccttcagtgctgaagttgccccgaccgctacagaagggcctggtgtccaagcggcctgcaacaaaagaaacagaagttctcagccaggcttaagcagccacatttttctgtatctacccagggcacccagattcaaattcagctgaaggacggttgcaccctcaggctccatctggcttgagaaccatttgttgtagtgtgtgaaatcagatgagactcacatcctgttataccaggtaggaattcataacctgaattccctgaaattataggcttgtatgccaaaacagtgtgtgattatgcataggggtgtgtgtgtgtgtgtgtgtgtgtgtgtgtgtgtgtgtatttccacccctggggagcggattcatagtttttgtcacattttcaagaagtcttactattcctatgatgattatgagtcactgccttgtgaaatgcattaggctggggctatgttactatttctttcttttctttttttttttttttttttttgagacagagtcttgctctgtcgcccaggctggagtgcagcggcgccatcttggctcactgcaagctccgcctcctgggttcatgccattctcctgcctcagcctcctgagtagctgggactccaggcgcccgccaccatgcccggctaattttttttgcattttttgtagagatggggtttcaccatgttagccaggatggtctcaatatcctgacctcgtgatctgcctgccttggcctcccaaagtgctgggattacaggtgtgagccaccacgactggccactatgttattatttctttagtgcctcatcaaggccaggcacataaaagatgcccaagaaatagttgttgaactgaatgtaattctgactttttgattcaatatctatgccacatttggcaagggatttagactatctggagcttagttttcttatacgtgaagttgggccaatagcccacttccctggggtatatccgagttaagtaaaccccttaagagctcactcttgtgtccttgttatttttttctgttttattttccaaagttttttgtggaaggttggctcaagttggtatgtgggtttatataaccaaaacattctaattttccgcaactaaaatgaggtagctaatggctttctaattctataaggacacctttcagtttggctctgtccccagaaaagtatagtgcctttatcttttatttctttctatcctgaaggctaagtggaggtcaacttaaagaatgtggggtcaaggttgacattactcgagccccttgaggcctaaatattgccttagctcagtttgcagaagtcattggtctgatctccatggagcttaaggagaagaaacaaaacccagttctatattctctgcactagagtatattcactctgtagtctctgtacgtagaaacagcttgtattaatatattttatctcattcttgacagcaggaagaaagaattttttaaaaaaagctgatttgtaaagtgagagtctaagtatgtactatctagtatggtggcccttggccacatgtggttattaggcattgaaacgtggctagtctaaattgagatgttctgtaagtgtaaaatacacatcagattccaaatagtataaaataatagactgagaagtatccattaataattttgatattgatttcaggctgaaaaaccaatattttggctctgttgaattaaataagagatgactaaaattatgtttacttgtttctttctcctttctttaacatgactactagaaaatttaagattacatgtgtgagtcatattttcattagacagcactgctctaaacaatcattttaactgactacttagcattactcctactgtgtattctcatctgcatttttccagggagttgacagaagtggaagataaactaacttatgcctaaagaaaatgtttttaaaaattgccttagaaacctagagcctgtcctgcagagccgtaagactatttcacttagggtggttaggtttactcttgaaataattgttgaagaacattttggtaatttttttctgagtggcagaaacagattttcagctctgatttgaagttgttgaaactcatgtagctttatcaactttagttattggagataaagacataattccaaagcagcaaaattccttgaaataggatgcatgtggaaacagggcatccatgggagagtatgagctctggagacacacaggcacatgcaaaatccctatctctctctctctctctctctctctatctctttttttttcggatggtgttttgctcttgtcactcaggctggagtgcaatggcatgatctcagctcactgcaacctctgcccctcggtttcaagtgattctcctgcctcagcctcctgagtagctgggattacaggcatgcaccaccacaccctgctaattttgtatttttagtagagatggggtttcaccatgttggccaggctggtcttgaactcctaacttcaggtgatccgcccgccttagcctcccaaagtgctgggattacaggcgtgaaccactgcgcctagccaaagaccctatctcttattgctctttgtgccatcttgtgccagtgggttaatccccttgagattcatttctttgatctgtagaagaggacttatcttcccctcatctaatctttaccttaaagggctgttgggaggattaaatgagataatacaacagtgcctgttacacagagggagcttatatgattgtaatcattgtaattgctattaaattggaacttttttctaattcttataactcagcactatcacaggcagcactgtgcatttgtaagaatactgaaatgtgaggaactctactccttattggaggaccttcaggaatcccatcctctttccaggcctcagtttctctatttgtaaaatgaggtgatggggccacagcagtacctatcagagagtgctctctggggtagaaatttcatggcgtactcataggttttggggtagaaagtgggtagatttcatggtcaaatacgttttagaaacttataattaaggtaaaatagggtttttcaaagcaggacttatcagaagcctgaaaattcctctgagaagcagttgtcgccgtgactcctccaagcaggagagagatggctgcagtctccacacttatttgaacataaaatctctttgtaatgaacactctgggaagctagttttctagtgagcccactttggaagcaagtgatggatgctgctatgctcttcatttctccatgtttgcacagtgtgggactgggcgggccaccagctcatacctgtggcaggctggagacagcagcctgctcctgcagtacattgctccctcagggaagacaccaggttctccagctcctccagtctgctcagcagctccttaacatcaggggctgcggcacagccacaggcccggcgggggatgttgatgcgatgtgtgaagacaatctggttttccccatccactgtgtgctcctgaaagctttcgctgggctctgaaggcggtgccaggtctttctccccactggctgactccagatccaccgaacactgggatcccactggcagcttgatgttgtaaacgtggttaaacaccactggctggttctcttctggcagggtggcgttcaccccactctgtcgcttgtgccggatgactttcttgaggaccccaccttcggtagcgagggcaaggaaagcaagaaagacacctgccaacagctgagtcatggcccccatggtggaggtgggtttggctgggtgctgctggggctctagggctctagggtatctcactttcagcagaattggggatttagaagcacagagtagacttcaaatcagttgtccctgatcttcttgaaagaattattttctacaagcaaagatgaacaaaaaaattatgagtatctactattgaatatattgaatatctacaattccaagtgaattttgattttatatccctgtatttgaagctctcctgataatttttcattatatacccttgaaataacatacaatggtctctaaaagaactttgtcacttgaaggaatgatttcactcactattcaacttctgtaaatttaaggagacagaaaaatagagagaaaaaggtaaaatattgaaataaaatagacataggtttgtatcttggctgtagctctggtcccttggatacgttatgtaatttttctttgccttatttcactttctgtatagtgaagatcatagttgctaatgacagggttaaaagaatgatgtagaagttatttgtgtattcattaattccttcagtatttactatgtcttctgagtgaattattatagtgttataaaggccctggtcccggtagatgttcagtaactcttgcctcttattgattttcaaaactgatttccacaccatctgctggttctcttctgtcatgagaggcagaggttaaaataaaggactctaggaggcaaacagttttaatcccagccgagcttcttactagttatatgactgtcagtatagcattcagtctactcctctgcacctcagtttccctgctccttgatttatttccaaaaccttcaaaagtccagtttttagaagagcctgacagaatattcttgaaccagttgtctaaactgaggctcacagctcagaaaggatgtctaagagcctctgatgtcttctccaatcagcaagtacttatagcatttttacagaggtctgagggtggtagaaataaatataagaccaagtgtatacataccatcaggggacttaacaatagaattaagaagaaaatggaatcatccatccagtacttaaggagcaaagcaagaaagaatgtataggatttgttttgtggtatagtgtataactgcctatggggtttgaaaataaaaaggaatggtcaagagaaaggtggggcatagcttatgggaaagggagggtaaaatttaagctgagccttaaatagtgagaagaattagatgggaacagaatatggaggagaatatgctaccatgaagcaattctcactttgccaagttatcttattcatctctcttagagctattcacctgtatgagcaatcaggtagcagagaaaaggggacttgttagaggcagttgagaaactaaataaagacaggaagaaatggcagttataatatttactaaaacaatgctatggaggcatgtgagaatgatctatacacgatatgaagtcattcatggttttctttaattaggagatgcacccgagtaaaattcaaatgataattgaagagctattttatttatttatttatttttgagacagagtctcactctgttgtccaggctggagtgcaatggcatgatcttgactctctgcaacttccgcctcccaggttcaagtgatcctcctgcctcagcctcccaagtagctgggatttcaggtgcacactgccatgcctggctgattttttgtattttttttttttttttagtagagttggagtttcaccatgttccccaggctggtcccgaactcctgagctcaggcaatccacttgcctcaacttcccaaagtgctaggattacaggcatgagccaccgtgcctggctgctatttggtttttagcatgtcatttacaaattgacatttccctatgcccatgatattcttatactcgcacactgtaagttagttatttatgtcaattagtggtggtgcttggattattcagcctataagaaggtttctaactttttttctggaaagattttatcctaatgatagaatgcatcaacatgatcccaactgaccatctccttcctcatgacagaaagcctttgcaaaacttagagaggaattgtggcaaggaaaattgaactgggaagcattctatatgactgatcaggggcctaaggactgagaaagcactagtgaatttaactaagaaggtcgtatccacatacctaccacattctaattatattcttattgacactttaccaactgtccctgtaatatctgcaaaaacaaaacaaaacaaaaacaacaacaacaacaaaaacaaagaaacaaaaaatacccaaccctcttttgagcatgctttctcattgaaattagcttcttaactaacaatgtgtgggtctgtaatgtaggtaaggccactgaatgaagattattataaaaaaggagacttggcatgttctctcctttcaaaccaatttggccatcttatgtgtttactggacaaatatttattggctgcatagtctactagaatggctgctctaactctcttcaccttcacaaagttctactttcctaccccttttccatcaattcttagctttttttttttttttttagaaagggccatgggccaagtttgaaatgtttttggacttctccccaacacttttctgtgtgttgctaaatgacttaaatttccatctaaaaagccattatagttgctgattgagactccaaggcaaagagtttagggtaataatgaccagagtgtgagtagagtgaggatttctcactgtgtgtttaagagacgtaaactggtaccaccaaatgttgcatcgttgggggaaagagtatgttattcttgagcattgtgtatttcctattggctcatggtggtctgagggcagtgggtgtttttgtactttgggaaaaatccattatattttcagtgttgtagaaaatggttaggctttggaattaggcatacctgggttcaaatgtcactcactagccctgcaactttgacaagctacttatcctctctaaaccatgacctcatatataacaaaggagtcaaaacctttccagagaaaattaaggattagagacctgtacataaagtacccagcatggtgtcaagctcgtagtaggcactcattaaacagtagttcctattttgttgcgctcctggggaacaaaacctaacaagagtccatgtcaatagcctccttttacttaagcctgagcttgaccgcctagttgaatacagtcctaaactcagcagcaacttggatctagatcaaagaggagctgcagaaatcactggtgggtgaggaggtaaatttactagaactagaaatatttatatgagagagggaaaaaataggaagcaaataatgacctttaagaatgtaaaatattctcatgcagacaactggctgttttaagtctcctttgtggatgaacccagggaaacttacttgagattgcagttggaggtatttaggtcagacatgaagaatcatgttctgatagtaggacttttataatttcagaatgagcaacttattctacagagactctttagaaaacacagattctaatctttatagaaaattgatcagcaataaaaggtctggaaaatatcttgtaggaggaaggactacagacctgggcaggtttattttgtagttgagaaaaccaaggttgagtgggtcagggttaccatgtagaaatcctggcaaagcaggcactggcttgcctcttgtagcccctaaggacagaacaagtgcctctgtgtgtgtgtgtgtgtgtgtgtgtgtgtgtgtgtgtgtgtgtgtgtgtgtgtgcgtttatgtgctggggatgatgcagggagggagggttggttatgagaagacaaatttcagcacaacaggagaaagacttttctagttggaattggtacccaatagaaaggtcttctttgagaatgtagcaggttccaaagcaccagaatgtaaatagaatggcattgaagggcacaagttttataggcaaattgtcttaggtttgaatcactgtttgatcacttcctgttccttgtgcaaggttattatctgtgaccataagccagagtactgtcatcaataaatgtgttaagggagtcctcataggatcattgtgaaaagtgcatgagataatgtatgcgaaagaaatggcaaacagtctttggtagcagtaagagcttaataaaaggaaacatttgtaatgaaaaatatggactttaatgaatgtttttcttttctaggattttctttctcctaacctttgaaacccctactttggcatatgtctgtttttaagcaaagacaagagttctacagcaaagtgagaacttttcctctctcagtgatcccagaaaatatgcatgtcgtggtatgtgtatatatatatgtatatatatatgtatatatatgtatatatatatgtatatatatgtatatatatatgtatatatatgtatatatatatgtatatatatgtatatatatgtatatatatgtatatatatgtatatatatgtatatatatgtatatatatatgtatatatgtatatatatatgtatatatatgtatatatatatgtatatatatgtatatatatatgtatatatatgtatatatatatgtatatatatgtatatatatatctccatatataatataatagttgctccaattatattacatataatattataatatgtgatgtaacataatattacatattataatacaatgaaagataatatattattacatatcatattatatatgtaagtgtgtgtatatctttgatggtgatatttaaggatctggtaagtcaatgattgcaaagaagggaatcaggaagagacatagtctttgcattggcacaaaacgcagatttttggggtcccatatccaggacaaatctatttccaagctaagcatgttgtgctgctttttgctccgcctcagcttatgtatctaacgcaaaacaagacacacttgtgtcagactttgctttctttattaaaattaatttttagagtcaaacaaatacctgtgacttatgaaattgtttttgtgagattttctgtgtatctccatccctgtcaatgtctcaaaagctagttaatctggtgaacataaaatccacaataaaaacttccccgtgagatagaaaatttaaaaagagataaaacacttcgaattcattggtcttgaattcgaagtgctctgtcccatattccgcatgtgattattaaaattaatgaaaattaaatacaattaaaaatctcattgctcagttgtatcactcacatttcaagtacttaagagcccatggggcttgtggttacaatatgagacagtgcagatgaagaacatctctatcatccaaagaagttttattgagcagtactggtttagaggattgcttgtttttactaagcgcatggtacaaaatgaggaaactgagactcaaagcgatcaagaagagtctataagaaagtttcaatgttgttaagtttcttgactaatgaaaatgggtgagtacctcagacacaagagcccggggattagggagaaaaaatggcttctttttagcaactaactcacttaactatagcaagcatgtatgtgcattgtagtttccataccttacatgtttgaacatatccaggtacaagtgagaagcaatcctcaatgctattgtcctttgcagatctgaagagataactaccctgtgtcagatcagcatcttttcccccagccttgtccttgggttaagaaatatttttttcttcctccctctgcacaccttagagtctcgtaagaatcttctccccacgttaaactaaaaccaagttgctccaggaaccactctggccaagtctaatgtctctttctgtctgcttcagcctctccttagaagctggaggagcttgtcaaagacaactcatgactcccgtttctctgctgtcctgcactgctgtgctccagagttttgagggcactcagtccatatccttcagccatctaaacatttccattaatgaagcagttgcgtgtgggggaaagagtctggtctttggtgtaaaataaacctgtgttcgaatccagttctatcactttagcagctgctccctatggccattccctttctcctctgaacctcaatttccccgcctcctctccctggagatacatatgtctatctcatagtgttgcaggagagtgggatgaaatgagaagacatatgttaagctactggcacagtgcctggcacacattaaggtgtgcttaatatgtggtagctaatgatagcagcagcggtaataacaacactgatccaatagagaatagatcagaaagaaaaccttgtatccagaagggatgggggaatcagggagatacattcatgattataacaagtaacaaaagagattggccaactcatatccattgaaggtcccaagaaagacatctcaaaaaagtggtatttgagatgtacttgaaagatgggcaagattctgaaaaatggttggatacaactccagtaggtgggttcaaattgaagcctacagcaccctagaaaaaagaaacaccatgagaaaaggcaaagaagttggaatgcatgggtggtgaggagaattaagaagatagctgtaataatagtggcatctccttgtgggtgccagatacatgccaaggtggtgtagcatgcagggaatatggagaggtcttgttctactagggtataaaataatgcataggaaagcagaaaggtagagactacatggtattggcagaagccatattgggaaggatataaaagatcaatatgaagagctggtacttaactcagtaagcaatatggcacctctgtaaggctaggtgcctaactgctcacagttagtcatctgttgagaaggctgggtagaatataggctttaatatttagtcccccattctccaaatacctggtacatttatggccccagcccgctacaaaaaataagaagataaaaacaatggtcctgaaagcttttgtggggagtgtggggtggaagaagggttaaatgttaagctttaatcttatttcaattgccttggtgttaaatgttatcagtgttgaatcatttcttcagattttggcattatagacttttattcagagcattactgtgagataaaaatttatttaccaggttgggaaaccaaggccagtgtcatgccagtcgtaatggctttttagctcataattttacacattaagctgcctcttggcttgctgtcaaatccttctttttttctcttttactagtagagctgtttggtagctaaccttttggaagcagcagggaataggctaacagttatttttgggcacctcactgcaggacaaagatcattgctagacgaagaaatcaacaatctgattttttccctggtcacagctggagaataaacaacttcatttttagataaagatgaaacttccaactggctagaatcatatttcagaattagttacttatgatttcatttttagtagctcatggaatatatttatcttgttgacttaagcacatacatgaaatattctaggtttgggaggacgaggagaattcctattgtttagaaatgcagatgaatttgtttccacatcattttggcaacccatgaggcagcttacaccaaatttttcttctcgcttacaggccaaagagttttattgtgcatggcctgtcaagcatagagttgcttacatgggcgttcttaaatgtcctagaaattcctcaccctttgtccttcccaacatccataaattcctttttggaatgtgtcaggaagagagaggagccaggaaacagccttaagtgtgtatttttttttttttttttttcctgaggacatctgatctccatagttgagtgagtccggtgcaacctgtgtcataaaagaattgagaaaactctaactgccaaagcgaagaccctcctaaccctaggtgtttgaagaattccagaactgagaagtggttgtccatttaggcagcacagtggcttagctggtgcccagttaagatgctgggggagccagtgattatccaagaggactgagaattaatttctaaatggtttattcttgcattcaacagagatgtgttgaacaagtgtaagaacgggctatgggatagcctagtggtggtggggtgtttcagaagccaatgatggataggtcttgcccttaatgagctcacagtcaggtatagaaagcagacatgtaaacagatacttgttgtgaagaatgataaatactaacatggacaaatatccaagaaacatctgtgcaatgtttgaggatatctgctctacatcagtcaaacactgttagatctttactctgccacttgctattaatttgaaccacatggaatcaccactcttttaggtcagaaatagttgggtagtagcaaatccaaagggttccatccagtagctgttttggttgtgtaacattgcctgtctgggccttaattttcacatctgtaaaatggtaacactaatatcaactgcacaataaagttctttcaactgaaagtgagaaaaatgagataatacaggcaaaacactcagtaacaaatacttaaaaggatggagaccttagcaactggtgtgtattggtattatatgattattctgtcttgtgcttggagacagcatttctaacagaaggctagtctctgaaggatgagatctataagacaaatctgggaagccctctctttcccactgttgctttttccatggaaatgtataaatcttagtatttcaatttgtcaagtagcagggacactctaaaatttttaggaaaatgaggaggctgtggctacagccctggttttcctgttatcctatctcttctaactcagtagcaagaaaagcaaatgaattagcctggtgtggggctcttttctgggaggtcaggaccctggccaaggttcctcaggggcagtgctgctgttgggatggctgtccatgctgctgagccagggctttctactgaatagactgcctgtggtttagtctttcaagactgtgttcctaacgggaaacatttggcccagcttctcagtactttccaaagacacagacagacatcaaattataggatcaaaatcatgcttgagcaggacttagaagcaactgtagaagatcatttggtataggcatggcaagtctgtggcacaaaacacttcattctagtgcatggggcagacacagctaatcgataacaacacaattctgaggagccccacttaagaatcattctaaatcatcacttcaggcagccaattaagtagtatataaatagaggtagtatatcacatgaaacttatttgccataatacctagttatttaagagaataactgaattgaaacacccagagtcactagctaatcagtggtgactttactaattaactcctaaagctgatattaaaatccagagattttgcctttgggtcaaggaattcgattaagatctatctcttcctctagaccattgggaggccttcaaaaaggagtgcatatgtacggcatggtgactacagttaataataatgcattgtatacttcaaatttgctaagatagtagtagaccttaagtgtctttatcattgacacacagaggtaactatgtaaagcgatggatgtgttaattagcttgaatctagtaatcatatcacaatgtatacatatattaaattatcacgttgtataccttaaatgtataaaattttaattttaatttgtcaattatacctcaataaagctgggggaaaaaaacctttaaaaatgcatatgaaagtctttcagtaattcttagtctgaggtcattgtaatgatctccagagagaaatatcagtggtgggatcctggagagcatttgtgttaaagtatttctagacttcttggccctgatgagttttttacttttctgtctatctatccatcaattcatccaactatctactttttcagtacatacgtgccaagccctgagttaagtataaacgatacaacaccaaagaagataaacatgttctgtataatcgcaaagctcataatttcctcccaaagagtcacaaaatacaatttatttattttttgagatgaagtctcgctctgttgcccaggctggagtgcagtggtgcgatctcagctcattgcaacttctaccttccaggttcaagcgattctcttgtctcagcctcctgagtagctgtgattacaggtgcccaccaccacgctcagctaactttttgtatttttagtagagacaggatttcatcatgttgaccaggctggtctcgaactcctgacctcaggtgatctgcccacctctgcctcccaaaatgctagggttacaggcgtgagccactgcacctggccgcaattgattttaactccatgtacagttgatttagtatttgtgatattcttaagtgccactgcaggttgggaacatggtgcactctcccaagccaatagcaagagtataaatgttaacattctttcaagagcgaaatgctatttacttagtatggacctcccaatgtgctgggtactttggaaaataggccaagtaaggagctattttttgttcctagagatctcagaaactagaatatcatacacaagcaaggtctggtattaatgccagcctgaatgagataattatgtgacactttgcactgggaagttcatggggggcttcctagaaaaggaaagaattacaatcaccaaatagtggttgaaaaggccttggaagatcattaagaagttgacataataataataatcaggaagttgacatcatcatcatcaccatcataagtaatacagatatcattaactataatttattaagtgttgattttgccagagcctgtgcttagttagcattttacatttccaatttcaaattcacatacaattatgagatagtatttgtaccctcattttgcagctgaaaaaactgaggcatagagtctttacatggcttgtgcaagttcagacattattaagttatggagtcaggatttgaaccaaatcccatctgagtccaaagtcagggctctgaaccatgattttatacagccttttgtgctggagggccaagcaaaggagctatgagtcaagaccagccccaacctctgactatataacttcccaacacctggctcaaagcagaatactatcaatcctccagaagtagaccattaagatgccagacagcctgtggctgctgtggagatgaagcaagctgacagatacatttgggatgcttccatttctcagtgatcattcagcgagggttccagatgccttgaaggcttctagaagcctttttgccatctctgcatgaataaatctatcagtccttcaagatgctgcttaaagaaatctactattgaaaggtttatcaggtaactttggcctaaatttatctttctctcttctgaattgtctggggaattgatatgatattatttgatttatcatttaaaaaaagatttggaatggctttattatgcatgcataactccttctcttaggaaattagctaattctagattgtatttatattagtctataaacagttggtttgcatatgtgcagttagattgtatgtagactataagctctatgagggcagggatatatctgagacattcatctctgaatgcacaacacaaaacactttatctagaacatagtaaatgcacaatatgtttatattaaatgaaatgaagctgaatgtatttcttggtttgaacttacacatagcaggttcttatattgtggaattaatgaatgaacaaatactcttactttcctgatggccctaatgtaattagctctcctgtaatctcttctacagtaagatgtatcaaggaatttgtcacagcctcagttctgtaattagttcgttttaattcattcagttattcagtgagtatttactacgttccagacaccacactaagtgcagaaggtacaaaagtgacaaagacagacctagctccttcccatgagattctagacatcaacccaagggcttttaagagctcagtactttctactttgagacaagatttctctatgatcaagtaaactcctttggcagaaggtggaattggccaggcctaagatgcactcagcatgaaaatttggttttggtgtgaaggaagcatcctgggttattagttagtaaccctttcaatttcattgcagtatttatcattttgttgtactgttgttaaatataggtctccctttctcattttaaatttttaccttcattacttttttttaagttcccagatacttggcctcttatgaggccatataacaggaagtgcaataaatggaagatctggaggagaagctctgagctcctcttctgccaagcaggtctgaccaacagggtcattgtgtgaccttgggcaagtcgcatccactcttgaggtctcagtttctcttgtaaaatgagcaactgtgtatggtttccaattctaagatccctttggttccagtgatctgtggtccattgctaatttcacaatatttttgttgaacttaattttgaatttcactttagacccaagtcaactggccaacattaagtacaaaccctccaaatagtgtttctttccatagtttggcttaagcattggtggtgcctcacgacttcctccctcctgccccttgaacagaagttccattaccaaccaaattaaatccacaaatcttaatccataaaatatttccatccagacacaataatgagattcatatttgtggtttagtatacctaagaaatgctcagatgaaatatgactagatccattgatacattcagaccacaaactgccctggtgtggtctggtttcaatttttgaaataaaactgcagagcacttgctttctctcttctatttcttgcctagacagaaaagaaaataaaaagtggttctggacaagtggcaacaatatagattcctgtaaaattctggaaaattatttcaaaaataaatttgaattcatttcccaatggaacaatgacctcttctattttggtcttcatccagaattttaagaaatctagttggctctttcagaagcattgaatagtgagttctcaaagtcttgagccaaggttaagaaatggaagagatttatctaggaagaaccgattacagacagacttacaacacaaccctaaataagagaacttctgaataggggtctgtgagatggttgcctttgtgaaactgttatcagccacccaaagtcagaaatttagtcccgaaagaccctgaaaaattttaagaaggcattgtgatgggagagacaggggcattgcctttagagtcaggaagacttaagaccaatttctacttatctgctggggagccttggacaacgtcctataccttctgaattgtggcttattcaactataaaatctctccagggttgtttgaggcagtgaatgggacaacaaagctataagtgcctgacatattaataataaacgttacacatatgttagtatatcttctcctcttctttccttttcctgtctccctttatgagagagctccatgacattgggcatattaaaaaataaaagagtaatagtgtagaggtggttcaagcactggttaagaagtagaattggtttgggatcaattatgtttcaactcaaagagctgacatagctacctggaactgccttgagaaagattctgtggctatgattaggctttcgggaaaaggtgctgtgatggattagcaatatccaccatgggtacaggagtggagagtgttgacgtgtacaccaaatatttggcatagcaaaactagacagctttggaaatctttcccgatccaatgtgctaatattcaaatgaatggaatcctgcttgagtgggatttgcatcagaaggagccagatggagccattgacaattacaaaatcctgtttaaatcaagttcaataaagtctcatacattttgatagaatatgactcatgaaacaaaaatacgtctctaggactggaagcaggaaaccagactctcagggaaaactaagactactcccgtaattaatttgtgtgacctcaggcaaagcaaacatactttcattgtctattttccctttcccaaaatgggaccatctaaatgctataataataatgaacattgattgcatatgtcgtctgtgccagacactgctttttgtgtcttctgtggattatctcattgaatcctccccaagacttctgaggtagttgtctttatttttcacagtttatggaggagaaaactgaggctcacacagctcaagatcacatagctagaaacggggaacagaaatttaaatcaggtgaactgattcacttgttttaattatgttaaagggtggtttgcataactaaggtcggggtccagagaaactactggtaatgaaatatctttatgatctacaggcaggacaggaaaaactgcagaaaaatctgaaaaatagagatatgtctaacccccttaacttggctttaacttagctgtgtaactttaaacagcattttctaaagtgtaatctacaacacgttgataggtactaatctgagggaaaaagatttcctaattaaacacgtttggaaaatgttattttaaaccaaatatgattttaagccaaacaaattacacaactttctttacttcaggtttttccagggtgtttaataggttcatgctcgttggaaatctcgaagaaggggacagtttatagagtgtttcccaaatctacttgattattctgtttgaagtgagtcacaggattaggttggatggcacacgatgggggaagaactgatagagaacaaatcctagacccttactcctttcatttcttcctgtattagaaggaagtagagatatacctaactatgacctctctgggataaaatgtgaagctctatgttagaggatcttgagcaatttaaactaagagtgaagcaagtaggtcaatatttatactgtgcgtggcactttacaaatgctgtttaatcatgttaccaactctgggaattagggagcattgtttgtattttactggtaagagaactgaaggcttaagaaggttaagtaagtggcctagtcagcaattatttgaatcagaattaagaacagtcttataattccaaagtctatgctctttctgctatatcaagttacctttgaagtaagattcattgttcaagttaaagaattaatatttatctactaactatcagagagaaacacaatatcattaatatgaatagagttgttggatttgcaaaatggaacaaggtaggatggtgtttgggaattggggtttacataactattttatttactgttgtgaacttgaggggagggcataggccaggtggactataatatctgtgtcttaggcaaatctttaaagcccctggagaaaagcctgctctccttgagtctgacctgaagagaaggttaataagtgagaggaagatacagtgagaagtagcagatgggggagctaaaaatctatcatttctggaaaactgggcttcacactatgtactatctaaaaaacgtgtggtttccaagaaatcagtcaagatcagagagcgtttcagaggggctggaaattaccactttcagttttgaaagcatggacttctatgaacaaacaacttatttgtataagtaaggaaaggagggaaaattccttctaaataggatcatttaattcagcatatggcaggaaattcaagaaattagccagagagaaatactagtcagaggaaggcagaggcaaatgaagatgaatcatacaaatgaataacttttaatcattattctgaacttcttttaggtatagagtttggcattatgtttttggaggggaacttactagatgattttttttttctgcttcaatctctatatacacaagtatgataatatccaccttgttaggttaaggtgactggaaagtaagtataaaaatttagtaaggttgactggaagggatcagtaaacatttccttaaatgaccaaatagaaaatatgtaaagctttgcagttagatgatttcagtcacaactattcaactctgctattgtagaggcagcagctatagataatacacaaacaaatgagcatggctgtgttccaataaaactttatttacaaaaataggctgccaccctatggtttgctaacctctgctggaatatagtagttattcaataaatgacagcttctattatgaaactaaatacagattgaattgaacaataaggaaactaacattttgttgagtgcctattatatacatttttatgccaaatcttacactaaatgctttttattcatgctatcatttatcttgtcatttgtcatgacaacctggtgagttaggtattattatgcttatttgaaaattaatttgagactcagggagtttccatgactggcttaagaggcagagccagcttttgaatcctgatttatttgtggttctaaaatgtctgctttcaactacattgagctacactgggctgactcctaaaggaattttcttagttcagataaggtaaaaacttaaatttttactgctccataaagaaagagatcagcattcaagtggatgaactcactttccatttcctagaccttcagcagctctttggtggctgtgcacatgtaagcaccaaaatatttgacctctgtttttctcccagaacctctggctggatctcaagttttatgtacttcctttttggagaatacttaagccaaggtgtactgtttgcaaacacttattagccttgggtagatattggcgagtttccgttggcatcaaatgggcttccagaatctgctgaggcctggctgtgctcattgattgtctttgccaaaaagagctgctaattaggatgacatcctgcttgtctctacctctagagctaggttttccttcctgggcatgcctattttgtcccaagcagtatgtttggatttttagtgcagatctagatgaacaagagcaaatttgcagtccctttaaaatctatgaagccttgtgctccagtgaagaatttcccagactacgttgcaagatgtttttaggtagatgtcctatggtcaggtatgtttggagatactgggctaacgaaagttgaacagattaattacagcaagatatctcagatgatgcactctacttccctgaaccatccattggcttctaaccacactcagaatgaaattcaaactcctagccattgcctacagagctccttctctcatttcattcagacatctgcacaatggcacattcacctctcaccccatctaaaagagcactcctctcaccaccagtcattgtttatgcccttaccttgttttgtctttcttcttagcaaatatcactacctgaaattgtgctataagtttatgtgattcctttttattgtctgccttccccctgctatggtctgaatgtttgtgttccctcaaaatccacacattggaacataatcaccagtgtgacaatattagttggcagagtctttgggaggtacttagatcatgagggcagaggcttcataaatagaatttgtgcccttattaaaagagaccccatagagctgccttatgtcttctgccatgtgaggacatataaggtgccatcttgatcttggacttcccagcctccagaactgtgagaaagtaatttctgttgtttgtaagtcactcagtttatggtattttgttgtagcagcttgtacaaactaagatatgccaccataatgtaaacaccatgaataaaaggatcttgactgtattgctttctattgtatcaccagccctaaaactatgtattgaatggacatatgagctgtgcatttccaagaacagaagagtaccaagtgtttcccaaactcatttggccacaaaacccttttttaggtgattcccatgagaatgcttttccacatgacacacttttgggaactgcttctctagtgggatcttatcatcaagaactatttgatcaacaggtaacaaaacaatgacaacaacaaaacatttatattgaatgccagtttctgtgctaagcagtgttcatgaactacatcatttaatcatcacaataaactttaaactaggtgctactactttgcttttaatatggataagaagaaattagcttaaagaagctaagtaacttggccaagatcacatagcaagcaaatacctctcaaacccagaggattcttatgccaaagtcatactcttaaccattattcatttcttcttgtgggctgtgagcttctccatgtcctaagatagagagctctttgtctccatcccacccttgagcctgttctttcctcctattagttgttgactaatctttgttataacctccagattttcagctatctcttgtgactcagcctcaaatccccagacaggactcctctgtccttggtactggtttttccaaatccaaagcaatttgtgtttttatcctgaaggccacctctgaaagcaaacacattccttgaggtctgtgtcctgagacagtttcctgtcctagggctgggatggtttcctcctatcacatgttgtgtcatcacactgcatacttgcaagccagtgggtgaagcgtgaaaacaacttcaagctctgggctttctgagcaaactgctaaggaagaggatgtccaaatctgggacacagcaaggactcctattaattgctaaagattaactttattccagttgtgctaggtttcagataaaccagatacaattttttcttttaggaactatattgtcaagaggggcagacaggccattccaggatgataaaggagatgatagatttaaaaaaagaaacataggtagaatgagatgacagtaaaagggcatctaatttacctggaggaagtggtgcctgaactgaattttgagagaaaaatatgaataggtgaaaaacataaaaaaggatattctaggcacgagggaatggcatttacaaggatataaaaagaataaaagggttgatgtgaacagtatgaatgacagctgaagtacaggatctgtttagagaccagaagcaagatcatggagaatcttgaatgtcagaatatctggacttttttgcaggcagaagaaaagcatttggaaatcttgaggcccaggaatgttaacctctatgtctcaggttgaagaaggggaaggctgggttgctgggggccagtgggaaagctgttgcagtggcccatctgtgagatgctaagatctgaactacaggggtaatggaggtggggcagggggtggtgatcaagaaagtggggaggcagtgaacagatttgcttgtcaaggcagtagagactacaacattttgtgtgtggggttagtaaagaaaaaagaattaatcgaagatgttactattcattatatctgctgagaggaatagattgagggaggaacaatggatgagttttagttttggtcacactgactgtcttgctttagaataaaatacatttggaatcattgccgtgaaaggcccctccctggggtgaaattcaagagaaattatggctaaccaatgagttaaaacaactaatcaaaacacttggctccactatatacatgggaggatgttaaataaaaactagtccactttagtggctgccagaatttttttttttttttttttgagacagagtctcactgtgttgcccaggctggagtgcagtggtgtgatctcggctaactgcaagctccgcctcccaggttcacgccagtctcctgcctcagcctcctgagtagctgggactacaggtgcccgccaccacacccagctaattttttgtatttttagtagagacggggtttcaccatggtctcgatcaatttttttattactcatcagtgagggtactgaagggttgagtgaacttgtcattgataagaggttgccagaaattggtgacactggagtgctggaggctgtggcaggcagactctaaggtggccccattgatactgcctcccggcattctcatacgtgtgcaattacctccccttgagtgtgggatggcccagtgactttcttctaacaaacagaatatgactaaggtgatggaatatcccttccatgattaggttacacaggattgtgatgtgcctcttgcttatagactttctctctctctctcttttttttttttttttttttttttttgagatggaatctcgctcttgttgcacaggctggagtggaatggctcgatcttggctcactgcaacctacgactcccaagttcaagtgattctcctgcttcagcttcctgagtagctgggattacaggtgcccaccaccatgccaggctaatttttttgtatttttagtagatacggggtttcagcatattggccaggctggtctcgaactcctaacctcaagtgatccacccgcctcgggctcccaaagtgctgggattaagaggtgtgagcgaccatgcccggtaactctctttctcattggctttgttaatgtaaatggccttgttggagaagcccatgtggcaaggaactgagggtagccttggaccaacagctttgaaggaactgaggccctcagttcaatatctctcaagaaatggagtccagccaacaaccacatcaaca

SEQ ID NO: 41 - DNA, 150384 bp, Artificial Sequence
  Synthetic BAC sequence
aaatggtttattcttgcattcaacagagatgtgttgaacaagtgtaagaacgggctatgggatagcctagtggtggtggggtgtttcagaagccaatgatggataggtcttgcccttaatgagctcacagtcaggtatagaaagcagacatgtaaacagatacttgttgtgaagaatgataaatactaacatggacaaatatccaagaaacatctgtgcaatgtttgaggatatctgctctacatcagtcaaacactgttagatctttactctgccacttgctattaatttgaaccacatggaatcaccactcttttaggtcagaaatagttgggtagtagcaaatccaaagggttccatccagtagctgttttggttgtgtaacattgcctgtctgggccttaattttcacatctgtaaaatggtaacactaatatcaactgcacaataaagttctttcaactgaaagtgagaaaaatgagataatacaggcaaaacactcagtaacaaatacttaaaaggatggagaccttagcaactggtgtgtattggtattatatgattattctgtcttgtgcttggagacagcatttctaacagaaggctagtctctgaaggatgagatctataagacaaatctgggaagccctctctttcccactgttgctttttccatggaaatgtataaatcttagtatttcaatttgtcaagtagcagggacactctaaaatttttaggaaaatgaggaggctgtggctacagccctggttttcctgttatcctatctcttctaactcagtagcaagaaaagcaaatgaattagcctggtgtggggctcttttctgggaggtcaggaccctggccaaggttcctcaggggcagtgctgctgttgggatggctgtccatgctgctgagccagggctttctactgaatagactgcctgtggtttagtctttcaagactgtgttcctaacgggaaacatttggcccagcttctcagtactttccaaagacacagacagacatcaaattataggatcaaaatcatgcttgagcaggacttagaagcaactgtagaagatcatttggtataggcatggcaagtctgtggcacaaaacacttcattctagtgcatggggcagacacagctaatcgataacaacacaattctgaggagccccacttaagaatcattctaaatcatcacttcaggcagccaattaagtagtatataaatagaggtagtatatcacatgaaacttatttgccataatacctagttatttaagagaataactgaattgaaacacccagagtcactagctaatcagtggtgactttactaattaactcctaaagctgatattaaaatccagagattttgcctttgggtcaaggaattcgattaagatctatctcttcctctagaccattgggaggccttcaaaaaggagtgcatatgtacggcatggtgactacagttaataataatgcattgtatacttcaaatttgctaagatagtagtagaccttaagtgtctttatcattgacacacagaggtaactatgtaaagcgatggatgtgttaattagcttgaatctagtaatcatatcacaatgtatacatatattaaattatcacgttgtataccttaaatgtataaaattttaattttaatttgtcaattatacctcaataaagctgggggaaaaaaacctttaaaaatgcatatgaaagtctttcagtaattcttagtctgaggtcattgtaatgatctccagagagaaatatcagtggtgggatcctggagagcatttgtgttaaagtatttctagacttcttggccctgatgagttttttacttttctgtctatctatccatcaattcatccaactatctactttttcagtacatacgtgccaagccctgagttaagtataaacgatacaacaccaaagaagataaacatgttctgtataatcgcaaagctcataatttcctcccaaagagtcacaaaatacaatttatttattttttgagatgaagtctcgctctgttgcccaggctggagtgcagtggtgcgatctcagctcattgcaacttctaccttccaggttcaagcgattctcttgtctcagcctcctgagtagctgtgattacaggtgcccaccaccacgctcagctaactttttgtatttttagtagagacaggatttcatcatgttgaccaggctggtctcgaactcctgacctcaggtgatctgcccacctctgcctcccaaaatgctagggttacaggcgtgagccactgcacctggccgcaattgattttaactccatgtacagttgatttagtatttgtgatattcttaagtgccactgcaggttgggaacatggtgcactctcccaagccaatagcaagagtataaatgttaacattctttcaagagcgaaatgctatttacttagtatggacctcccaatgtgctgggtactttggaaaataggccaagtaaggagctattttttgttcctagagatctcagaaactagaatatcatacacaagcaaggtctggtattaatgccagcctgaatgagataattatgtgacactttgcactgggaagttcatggggggcttcctagaaaaggaaagaattacaatcaccaaatagtggttgaaaaggccttggaagatcattaagaagttgacataataataataatcaggaagttgacatcatcatcatcaccatcataagtaatacagatatcattaactataatttattaagtgttgattttgccagagcctgtgcttagttagcattttacatttccaatttcaaattcacatacaattatgagatagtatttgtaccctcattttgcagctgaaaaaactgaggcatagagtctttacatggcttgtgcaagttcagacattattaagttatggagtcaggatttgaaccaaatcccatctgagtccaaagtcagggctctgaaccatgattttatacagccttttgtgctggagggccaagcaaaggagctatgagtcaagaccagccccaacctctgactatataacttcccaacacctggctcaaagcagaatactatcaatcctccagaagtagaccattaagatgccagacagcctgtggctgctgtggagatgaagcaagctgacagatacatttgggatgcttccatttctcagtgatcattcagcgagggttccagatgccttgaaggcttctagaagcctttttgccatctctgcatgaataaatctatcagtccttcaagatgctgcttaaagaaatctactattgaaaggtttatcaggtaactttggcctaaatttatctttctctcttctgaattgtctggggaattgatatgatattatttgatttatcatttaaaaaaagatttggaatggctttattatgcatgcataactccttctcttaggaaattagctaattctagattgtatttatattagtctataaacagttggtttgcatatgtgcagttagattgtatgtagactataagctctatgagggcagggatatatctgagacattcatctctgaatgcacaacacaaaacactttatctagaacatagtaaatgcacaatatgtttatattaaatgaaatgaagctgaatgtatttcttggtttgaacttacacatagcaggttcttatattgtggaattaatgaatgaacaaatactcttactttcctgatggccctaatgtaattagctctcctgtaatctcttctacagtaagatgtatcaaggaatttgtcacagcctcagttctgtaattagttcgttttaattcattcagttattcagtgagtatttactacgttccagacaccacactaagtgcagaaggtacaaaagtgacaaagacagacctagctccttcccatgagattctagacatcaacccaagggcttttaagagctcagtactttctactttgagacaagatttctctatgatcaagtaaactcctttggcagaaggtggaattggccaggcctaagatgcactcagcatgaaaatttggttttggtgtgaaggaagcatcctgggttattagttagtaaccctttcaatttcattgcagtatttatcattttgttgtactgttgttaaatataggtctccctttctcattttaaatttttaccttcattacttttttttaagttcccagatacttggcctcttatgaggccatataacaggaagtgcaataaatggaagatctggaggagaagctctgagctcctcttctgccaagcaggtctgaccaacagggtcattgtgtgaccttgggcaagtcgcatccactcttgaggtctcagtttctcttgtaaaatgagcaactgtgtatggtttccaattctaagatccctttggttccagtgatctgtggtccattgctaatttcacaatatttttgttgaacttaattttgaatttcactttagacccaagtcaactggccaacattaagtacaaaccctccaaatagtgtttctttccatagtttggcttaagcattggtggtgcctcacgacttcctccctcctgccccttgaacagaagttccattaccaaccaaattaaatccacaaatcttaatccataaaatatttccatccagacacaataatgagattcatatttgtggtttagtatacctaagaaatgctcagatgaaatatgactagatccattgatacattcagaccacaaactgccctggtgtggtctggtttcaatttttgaaataaaactgcagagcacttgctttctctcttctatttcttgcctagacagaaaagaaaataaaaagtggttctggacaagtggcaacaatatagattcctgtaaaattctggaaaattatttcaaaaataaatttgaattcatttcccaatggaacaatgacctcttctattttggtcttcatccagaattttaagaaatctagttggctctttcagaagcattgaatagtgagttctcaaagtcttgagccaaggttaagaaatggaagagatttatctaggaagaaccgattacagacagacttacaacacaaccctaaataagagaacttctgaataggggtctgtgagatggttgcctttgtgaaactgttatcagccacccaaagtcagaaatttagtcccgaaagaccctgaaaaattttaagaaggcattgtgatgggagagacaggggcattgcctttagagtcaggaagacttaagaccaatttctacttatctgctggggagccttggacaacgtcctataccttctgaattgtggcttattcaactataaaatctctccagggttgtttgaggcagtgaatgggacaacaaagctataagtgcctgacatattaataataaacgttacacatatgttagtatatcttctcctcttctttccttttcctgtctccctttatgagagagctccatgacattgggcatattaaaaaataaaagagtaatagtgtagaggtggttcaagcactggttaagaagtagaattggtttgggatcaattatgtttcaactcaaagagctgacatagctacctggaactgccttgagaaagattctgtggctatgattaggctttcgggaaaaggtgctgtgatggattagcaatatccaccatgggtacaggagtggagagtgttgacgtgtacaccaaatatttggcatagcaaaactagacagctttggaaatctttcccgatccaatgtgctaatattcaaatgaatggaatcctgcttgagtgggatttgcatcagaaggagccagatggagccattgacaattacaaaatcctgtttaaatcaagttcaataaagtctcatacattttgatagaatatgactcatgaaacaaaaatacgtctctaggactggaagcaggaaaccagactctcagggaaaactaagactactcccgtaattaatttgtgtgacctcaggcaaagcaaacatactttcattgtctattttccctttcccaaaatgggaccatctaaatgctataataataatgaacattgattgcatatgtcgtctgtgccagacactgctttttgtgtcttctgtggattatctcattgaatcctccccaagacttctgaggtagttgtctttatttttcacagtttatggaggagaaaactgaggctcacacagctcaagatcacatagctagaaacggggaacagaaatttaaatcaggtgaactgattcacttgttttaattatgttaaagggtggtttgcataactaaggtcggggtccagagaaactactggtaatgaaatatctttatgatctacaggcaggacaggaaaaactgcagaaaaatctgaaaaatagagatatgtctaacccccttaacttggctttaacttagctgtgtaactttaaacagcattttctaaagtgtaatctacaacacgttgataggtactaatctgagggaaaaagatttcctaattaaacacgtttggaaaatgttattttaaaccaaatatgattttaagccaaacaaattacacaactttctttacttcaggtttttccagggtgtttaataggttcatgctcgttggaaatctcgaagaaggggacagtttatagagtgtttcccaaatctacttgattattctgtttgaagtgagtcacaggattaggttggatggcacacgatgggggaagaactgatagagaacaaatcctagacccttactcctttcatttcttcctgtattagaaggaagtagagatatacctaactatgacctctctgggataaaatgtgaagctctatgttagaggatcttgagcaatttaaactaagagtgaagcaagtaggtcaatatttatactgtgcgtggcactttacaaatgctgtttaatcatgttaccaactctgggaattagggagcattgtttgtattttactggtaagagaactgaaggcttaagaaggttaagtaagtggcctagtcagcaattatttgaatcagaattaagaacagtcttataattccaaagtctatgctctttctgctatatcaagttacctttgaagtaagattcattgttcaagttaaagaattaatatttatctactaactatcagagagaaacacaatatcattaatatgaatagagttgttggatttgcaaaatggaacaaggtaggatggtgtttgggaattggggtttacataactattttatttactgttgtgaacttgaggggagggcataggccaggtggactataatatctgtgtcttaggcaaatctttaaagcccctggagaaaagcctgctctccttgagtctgacctgaagagaaggttaataagtgagaggaagatacagtgagaagtagcagatgggggagctaaaaatctatcatttctggaaaactgggcttcacactatgtactatctaaaaaacgtgtggtttccaagaaatcagtcaagatcagagagcgtttcagaggggctggaaattaccactttcagttttgaaagcatggacttctatgaacaaacaacttatttgtataagtaaggaaaggagggaaaattccttctaaataggatcatttaattcagcatatggcaggaaattcaagaaattagccagagagaaatactagtcagaggaaggcagaggcaaatgaagatgaatcatacaaatgaataacttttaatcattattctgaacttcttttaggtatagagtttggcattatgtttttggaggggaacttactagatgattttttttttctgcttcaatctctatatacacaagtatgataatatccaccttgttaggttaaggtgactggaaagtaagtataaaaatttagtaaggttgactggaagggatcagtaaacatttccttaaatgaccaaatagaaaatatgtaaagctttgcagttagatgatttcagtcacaactattcaactctgctattgtagaggcagcagctatagataatacacaaacaaatgagcatggctgtgttccaataaaactttatttacaaaaataggctgccaccctatggtttgctaacctctgctggaatatagtagttattcaataaatgacagcttctattatgaaactaaatacagattgaattgaacaataaggaaactaacattttgttgagtgcctattatatacatttttatgccaaatcttacactaaatgctttttattcatgctatcatttatcttgtcatttgtcatgacaacctggtgagttaggtattattatgcttatttgaaaattaatttgagactcagggagtttccatgactggcttaagaggcagagccagcttttgaatcctgatttatttgtggttctaaaatgtctgctttcaactacattgagctacactgggctgactcctaaaggaattttcttagttcagataaggtaaaaacttaaatttttactgctccataaagaaagagatcagcattcaagtggatgaactcactttccatttcctagaccttcagcagctctttggtggctgtgcacatgtaagcaccaaaatatttgacctctgtttttctcccagaacctctggctggatctcaagttttatgtacttcctttttggagaatacttaagccaaggtgtactgtttgcaaacacttattagccttgggtagatattggcgagtttccgttggcatcaaatgggcttccagaatctgctgaggcctggctgtgctcattgattgtctttgccaaaaagagctgctaattaggatgacatcctgcttgtctctacctctagagctaggttttccttcctgggcatgcctattttgtcccaagcagtatgtttggatttttagtgcagatctagatgaacaagagcaaatttgcagtccctttaaaatctatgaagccttgtgctccagtgaagaatttcccagactacgttgcaagatgtttttaggtagatgtcctatggtcaggtatgtttggagatactgggctaacgaaagttgaacagattaattacagcaagatatctcagatgatgcactctacttccctgaaccatccattggcttctaaccacactcagaatgaaattcaaactcctagccattgcctacagagctccttctctcatttcattcagacatctgcacaatggcacattcacctctcaccccatctaaaagagcactcctctcaccaccagtcattgtttatgcccttaccttgttttgtctttcttcttagcaaatatcactacctgaaattgtgctataagtttatgtgattcctttttattgtctgccttccccctgctatggtctgaatgtttgtgttccctcaaaatccacacattggaacataatcaccagtgtgacaatattagttggcagagtctttgggaggtacttagatcatgagggcagaggcttcataaatagaatttgtgcccttattaaaagagaccccatagagctgccttatgtcttctgccatgtgaggacatataaggtgccatcttgatcttggacttcccagcctccagaactgtgagaaagtaatttctgttgtttgtaagtcactcagtttatggtattttgttgtagcagcttgtacaaactaagatatgccaccataatgtaaacaccatgaataaaaggatcttgactgtattgctttctattgtatcaccagccctaaaactatgtattgaatggacatatgagctgtgcatttccaagaacagaagagtaccaagtgtttcccaaactcatttggccacaaaacccttttttaggtgattcccatgagaatgcttttccacatgacacacttttgggaactgcttctctagtgggatcttatcatcaagaactatttgatcaacaggtaacaaaacaatgacaacaacaaaacatttatattgaatgccagtttctgtgctaagcagtgttcatgaactacatcatttaatcatcacaataaactttaaactaggtgctactactttgcttttaatatggataagaagaaattagcttaaagaagctaagtaacttggccaagatcacatagcaagcaaatacctctcaaacccagaggattcttatgccaaagtcatactcttaaccattattcatttcttcttgtgggctgtgagcttctccatgtcctaagatagagagctctttgtctccatcccacccttgagcctgttctttcctcctattagttgttgactaatctttgttataacctccagattttcagctatctcttgtgactcagcctcaaatccccagacaggactcctctgtccttggtactggtttttccaaatccaaagcaatttgtgtttttatcctgaaggccacctctgaaagcaaacacattccttgaggtctgtgtcctgagacagtttcctgtcctagggctgggatggtttcctcctatcacatgttgtgtcatcacactgcatacttgcaagccagtgggtgaagcgtgaaaacaacttcaagctctgggctttctgagcaaactgctaaggaagaggatgtccaaatctgggacacagcaaggactcctattaattgctaaagattaactttattccagttgtgctaggtttcagataaaccagatacaattttttcttttaggaactatattgtcaagaggggcagacaggccattccaggatgataaaggagatgatagatttaaaaaaagaaacataggtagaatgagatgacagtaaaagggcatctaatttacctggaggaagtggtgcctgaactgaattttgagagaaaaatatgaataggtgaaaaacataaaaaaggatattctaggcacgagggaatggcatttacaaggatataaaaagaataaaagggttgatgtgaacagtatgaatgacagctgaagtacaggatctgtttagagaccagaagcaagatcatggagaatcttgaatgtcagaatatctggacttttttgcaggcagaagaaaagcatttggaaatcttgaggcccaggaatgttaacctctatgtctcaggttgaagaaggggaaggctgggttgctgggggccagtgggaaagctgttgcagtggcccatctgtgagatgctaagatctgaactacaggggtaatggaggtggggcagggggtggtgatcaagaaagtggggaggcagtgaacagatttgcttgtcaaggcagtagagactacaacattttgtgtgtggggttagtaaagaaaaaagaattaatcgaagatgttactattcattatatctgctgagaggaatagattgagggaggaacaatggatgagttttagttttggtcacactgactgtcttgctttagaataaaatacatttggaatcattgccgtgaaaggcccctccctggggtgaaattcaagagaaattatggctaaccaatgagttaaaacaactaatcaaaacacttggctccactatatacatgggaggatgttaaataaaaactagtccactttagtggctgccagaatttttttttttttttttttgagacagagtctcactgtgttgcccaggctggagtgcagtggtgtgatctcggctaactgcaagctccgcctcccaggttcacgccagtctcctgcctcagcctcctgagtagctgggactacaggtgcccgccaccacacccagctaattttttgtatttttagtagagacggggtttcaccatggtctcgatcaatttttttattactcatcagtgagggtactgaagggttgagtgaacttgtcattgataagaggttgccagaaattggtgacactggagtgctggaggctgtggcaggcagactctaaggtggccccattgatactgcctcccggcattctcatacgtgtgcaattacctccccttgagtgtgggatggcccagtgactttcttctaacaaacagaatatgactaaggtgatggaatatcccttccatgattaggttacacaggattgtgatgtgcctcttgcttatagactttctctctctctctcttttttttttttttttttttttttttgagatggaatctcgctcttgttgcacaggctggagtggaatggctcgatcttggctcactgcaacctacgactcccaagttcaagtgattctcctgcttcagcttcctgagtagctgggattacaggtgcccaccaccatgccaggctaatttttttgtatttttagtagatacggggtttcagcatattggccaggctggtctcgaactcctaacctcaagtgatccacccgcctcgggctcccaaagtgctgggattaagaggtgtgagcgaccatgcccggtaactctctttctcattggctttgttaatgtaaatggccttgttggagaagcccatgtggcaaggaactgagggtagccttggaccaacagctttgaaggaactgaggccctcagttcaatatctctcaagaaatggagtccagccaacaaccacatcaacaagcttggaagctaatcatcccccaattcagcctttagatgagacatcaaccctgtccaacacagacaataacctcatgagagaccatgaggcagaaaatccaactaagctgtgcttagacctctagaaaccatgagataataaatgagtgttgatttaaagtaatttggtatgcagtaatagataatgaatacggagatactagtcatccttggctcggtccgtgtgagttaaggctgttgagagaataagactctgctcatttttcttttctaaaagaatgtcttaattctgaaacttttaagattgtccctggcttccaagagcaagagtcagaagacctaggattccaacctgaccctgttgccaactggcggaagatcttagaaagatctttcccttctctatgtctcagtttcaccctctttaaaatgaggtatgctaacctaggccagcaatttacaaaaacattctgttttttctgcacagagccctttcatcaaataaaatttcatgaggaggctcagtgtacaaaatagataagtggaggggctttcattgaaataaggttgaggggaatcccctgcttggcctccctgtctctccacagcagcccccaaatctttttaaattctttttaaaatccagtctgcaagattctggcttagaggctgcccgtaagcccttttagtttgaaaattctgtattccctaaggagatttaagaaaatagtaacctacctagaagttaaagcattcctctgcaatatctgtgcatcgaccttcacaagaccatcccacagtcctgggcatctcctttggggactgtgctaatggtgcgtctgcccatggtgggtccgtttttggggaaaatgaactccagcagacaaagctcccgcctccctaacattcttgacctcagtggtgtacagtccagtgtggcagggaaggcaatcataggggtaattatgacacagacagtgggggacgtgcagagctcagttggaacctggagcagggggattccaggcagcctgcagggcactcatggcttcccttgggcagcacttgcttatgtgtgtctatgcttcaggtctcaggctggttgcagggatgtgatgtggatcgggctttgccctcatgtagcttaaagtctagtagagaaaacgtattacattatgggtcacatgctaatcatttaattacagtttttttcaagaggtgaagcctgaaggagcaagctggagatagcaaaattaaccagtctgtcaaagaacaccagggccaaaaagacaagcttttgtgtctttcttagctttgctgtgtctagccctctctcttgtcagaagatgaatagaattagggagctgagcatgacttccttactgaaatggttataactagcctctcaggactgggaactgggtttgatttttaactccaccaagtactttctgcatggtattgggtaagctacttaaacgttttcagccttacattgtgcatatttgaatagggtgggtgataagacttactagaagctatggttgactaaatggcatgatgcctatagagtcctcagtaaatattagctattacgattatcccctaggattctcctaggagaacatttcagacacattcttgtcgaagttagcagcagccagctttagggttagaggtgaacaacggtcaattctgaagcaaagctatctatgttcagaactcatgatatatctctggctcttggtatagggtatttgaggagggttaaaggaccaaacaaagctatttaagttaccatggctatatcatgaaggacctatgaacttcaggaaacttcaaaattctgagacgacgtggcatgaaatacatatttttaaaatctccattcacagatagactaaaaatgcacatggaagggattttccgttcgcgatctgcttttgacttgggcattttgcttttattccatgatgaagggccaaagagagtaatgatagtgacagggttgtttctaaagtggaagagaagctggaaatgtgagacaaggtggagggaaaggagtttaggcttaagggcataactgaaaaatgtctggccaccaggattagaatcaggttggtttgcagacttttctcctttacagagaagtcacaaagcatgtatagcccccgaaggtaggtaagttcaccatctctgtcttttacattgaatggaattatggcctggggtttgcaggaggctggtcatgtcacactttgaggggggttttcctccttggaagggagccttcatctaatgtttcccacatgttgaaggtgttcaaactggcccgggataagattcaaggggattccctacaatcttctcagagtgagaggtatttgaatcataatcttcctctctgaggcttccgctgaatttgtggctcaatttgtggctcggagcctacaaccatttccaagctgtcctgggattcatggccccaaggccgatttcactttacctaccaatcagcccttttaaaaccagatgtttggctcacctgtgtgcctacttttctgagatgaaaatcagcaggagtgacctgactgctacctctagtttcattcttctctcttccagggctgaaatttgaactttcctgtttccaggcagagagttgcaccattgagagctgacctttgctgagaaccatgaaaaatgatacatgcagggctattctgtaaaatcaataggcaccaatgccagctgggggcttctccaccatcttgatcattcactgaaagacaccatttaaggttctaaacttggtcagcacagcctgacttcagaaggcaatatagcacagcagaaagaacagtggggtattagttagaaagcttgggtcaaagccagctctgcccctcaattacggaaagacctcagatgagtcacctaacttccttgagtgtcgatttctttaaaattgagctagtaatttataatttgtagtgtctgagtgagaatgagatgagaaaccattggcaaaccctcctattacatatgtgacactattaactttgtgtttgtgtgttttaccatcacaaaaggacatatatttcgagccaactaaatgtttgcaacctactttttacgtttcaaactgaagtggcttcagcatgaagggggctgcgctttggtccagtggatatgttttcttgtaagaaagcacagctaggtgtctatagaaatctagagagagaggagagaatatgtgctcttaatttattgttagcattagaaagggtaggattaagggggatatgtttttcattctgtcagcttgaattctctttccaaattccattctggttatatgatcaggctactgctgtatttatgggtggccacagtctgcctggaggggcatatttagtcagaaaggaagtgttttccttctaaaggcaggcaagaagcagagaagcattcagaaggaacacggcagaatgtacctctgacttggtgatcacggggacctgggtgtgaaacctggctgtatcactctgagttctaggaccttggtaaagttattcagtctccctgttcttgaagccatctctttgtccaacaaatatagtccatacctcagagacatgctgtggatgatcccacaaaagcctacagtttagagagtaggctcatcatatattttggctatcattgtcattagaattaattaaaatagcctttgttaagtcttttatttctcattcatattcctgtctattacactatttgtggacttgctcttacttctgctacagatggtgactcagaggggcaaaaatccttgttgaagggcagaatggcaaccagaatgcacacagcctggtttcatgatttgtaaatgtgctttttgtcattgaagattctgtggcaatgtcccagaggctaagagcaaaggtgtaagttttagaccttgtgaccccacttcaaccaaagcagccctgcatttacctgtcatatactgggggtttgccctaaattcatgtaatgaatattttcatcattaaaaataagtttaaaaatcatgatcttagaatattaatcttggacaagtccttgtaaaatgataaacagagaaactaagaaaagtttccatttattgaacccttaatatgtggaaggtactatgccaagtgtttgccatatattacctcatttgaatgttgcaagagccctgtgagacatagtttgtcatctccattatatgaatgacaaagttgagggctgaaacgttagtcacttcttagagtggggaaggaggaggttagtgtgggataaaatagagaagctaggtttttaaaacaaagcatagaggaaaaaaatatttaatgactgtagagcttggcaacatccctttcaatccttgtccaatttaccctgtttgagcaaaccagagaatactcatattgtgcacctttttcttccccacaaagcagtcaccttcctgaaatgcaagggccaaagcacgctgacttacatctcctgcaaatgacttgtatgcgcacaaagccagaaactcttcacttggttgtctaggactgaataaatcttcttcagtcctgaattgggcttgcctggctgggatggatagtagttttcctttctaaaacacatatgggaaagctctgtaaaaatgggggaaaaagtctacaaaaacatgaaaaagaggcattcattcttcaagtggtgctccctgtcctgccctccctccggacagaaagcttttccaaagagtttccaacagcatcgtacttcatagctgtcagctttagaatctgcagatgcctaaactcaaaacctcctgacattctggaatcaaaatttgacattaacttccagccccgggctactaccttttctccaacctgtgccaacacaacctcctgcttgtaaaatacagccaagtctcagacctgccagcctagtgagacaccctcagattgggtgagataaaaagcgggggctgggggcgggctgaggaacaacacacaagaaacaatccaagactggctcaatgcctcttttaacttccagagtgatggcagtttttggcaatgacaatgattatccaaacttccagttattaagcagtcattgctgatctttctatacctcattttctcctcaaaacgacagcagacgctattgtccccattttagagatgtgaaaactgaggattaaggaagtgatgtatctttctcagggtcatatgtatggtggtggggagaataccaaacacctctggcttcaaacctaagctcttattcctcttacaacactgatgggtgagaagaacccctgtgttctttccaaagtacaccaggggcagcagggttcccatacctgggggatgttgttgctcagatctttctgtgatgagaggtgaggaggaggaggtgattctagagacatgtgggacgctgctggctctaggcaccccagtaaagctgttctccaccactctctagctgcctgtcagttattcatctggcccaggagccacctcctctcttctgtcccccagctctcatttccagggtgaatattttgaggaccaaatgagggaatgggtacaaaactctttgtaaactttatgtaagtgctgtttagatataaacttttatattctccctgcactcctctatcaaactccctctaacccatcccaggggcaggctatgagcaaagtctgccttaaaactctactgccctaaccctcaaaataaaagatatatacaggtgaatcagccagactagaagtaggagagcagttgaagagaaaatttttacttttcctctgcagaacagcagaagataacaactttacgaaaagttccttccaagtctgactattcataaagttaaaacaaacaaaattacaagaccagaaaagtcaaggtgcatctgatataaccaatacacactccttttttttccagcggtggaaaaaaaaaccccatatgttttgtaattataatataaaatcacaactcatttggtaccaggaatgcaatccttacatcataaggatctctagtgatgagggcaaaacagacttacctttccgatgggcgagagacctaggtccttggaagaagtacctggagtgtggagctgcggcggttcccacgtgcgcgttcccccgagttccccagcagcgctgcctttgtgcccacggaggcgggggcgtgtatctgcgcgcgggagaggcgggtgacagtaggcaggctgtggccggtgcagccaactttggctggcttatatagcgagctccttcctctgtaatgggacgcctcgcctccagacatcctttcccactttttcagttggcgaattaaaggaacagccctcccagcggaacagggttagctcatgaaagacgcactcactcctggctctcggccagggaaggaacccatttgcatacaatttatggcgaaagtaggaattcccgcctgcccgcccccgaccccgagtagctgttagtgaaatgtgatttttgctttgctccccacacgggttttctaattgtgagacggatgcctggggagcaagagggagtaggatccgcagccctggctcccctcttgtacttggtcaagctggaaatgggaccagggctcgcctgggctctgggcagcagctgctcagtggcacctcggagcgagtacagggactgagcccagttcctggaaagaggagataaagcccttcaaaagcctggggggtttcaggtttctctgggccagcggagagataacccaggattaggtctcagcaggtggggatcgtgcgggacgctcacatcagccctgcttttcttgtgtgggagccagccttgcccagctgctgggaggcatctttgttccagccccagtgtcctgcagggcagtagctttttgacattgttcatgccctgtgcctggtgtggtcttctcagctgggtctccagggggaaggatttctgaggttttctcttagtgctgaaaggcgtcccccacagccctttctttaaagaaaagcaataatttaaaaaggtaacaacctaatccttgagccataagctgcgcctttgctttccagcctgccgtggatttcctccaagctctgagtcatccgttcgtttggtggttagcatgcattgagtatcctcagggcatacaggggcatttaagggagtggagaagtagcacttcacccgtgcctagagacttctgagcctgccgcagagcatagtagtttgtgacagtgaagtaaaatgaagcattaaatgtaattcaaaacgcaactaccattgagccctcccttattaagtctataatcaggtgctgtgcagggtactttatgaacactatttttgttcactatttttattatatccttgtaaccagtaagtaggatagacacaagtgtctcttttttacacaagaaaactgacgtttagagaagtaatgaaactttaccaagggaatacacctgggaagtgtttatattacaacactgggctccagagatctattacacgttactgtttaggaatagggtatgatgatatttaaacaatgttttatgctgtattagattgttaacaccatttgtgtagaaatcacagccatatttgaatatggaaaatatatttatttgctccataaagctaattaggagagatctttgatttttaaaaattaactactaataatggaggtctcaattatccacttattttcaatattaaatgatatcatccccacagttattattgttgctgtgggcctcagtttccccatctgaaaaaaaaagcaagacacgattaggtcatcctacggttgctttggctgtagtattttaggattctctgctaaagtgaccctcccagacagcaagaaagcccataaatagtcatgtcataaaaccgctcatttgaacttttgatccattttggctgattcaaatgttggttgtttgggaagttttaaattctgtgctttagccaaaggatatttcagtagcatgaagctgtgtctcaaccagcagtgagtggttcctactgagttaatctcttgggttagggattaaaatattagaatagtgtacaatatatgtcatatggtatataaactatatttgtatagaacatataatcaatatatttataattctatgtgagtttttaaataagacaagagcgcatgctagaaaactagatagatatggctttttcggggaatgtctcaaactcgaactcctctccccagttctttaggattctacaatcgttgattagtgtctaccacaagtggtatggtcaatcacagggaaactaagccaaatatgaccaggctggccctcaaagcaggaaaaggctagcagaggtgacaaacaagaatactattatgggttaagttaacaactatcatataagtgtattctgataacatagagaagagatgatttatgcatttttaggagaggctacttgtaaaaggcattttctccaaaaagctatgtggcatcttaagctttttggcatttgagtaaggagtgcccagacgaggacgtgttttccatccctgtactgttcgcagcctctgtttctggtagatgggtccatatgcaccaggtactctacaatacccaaactttgttcatgctaggatgatgccctaggctcctcacctccatgccctcacatctatttatcatccatttctgatctgacttcactatggagcttcctaaatggaagaaatccatctaggaagagatgtttctatgcactatggcatttgtaactctattaggacatccattgcatctacatggtataattacacatgtgcatgtctagattttcctcctagatgctaggcttcctgaggctggtgatcacacttgctttttctgtacctggcatagagccttgggtatcatagaagctcagtaaatgtttatagaatgaatgaagtaatggaggaacaaataaatgtttgacatgttgtgctttataattaaattcttccttttacaaccatagaacctgaaaaggaaactggattattgtgtccaatgcttccatcgcacagatcagaaagtggggtgctgagaggaagaatgacttgtctgaagccactatgcctgctttccaggaagaaaactgtcacaatcagaactgagcaaccaagccacactagacattacagcagaggaagtttatggaaatgaagaaccatttttcctcctgtttggcagaggccatacctcttggcatctaatccctcatggttgcatccttctgagaagcataagcacttttttccacttgagagggtagaatgaatgcatgtaaacaccacccctgcacagagcttcctgccaaagactgattttgttgttgcttgtttgcagttcttattcaggagttgctggtggaggctgtggtttagagaccagaggaatgtcatggtttgcctcaggtgagatcattctcatttctttaaaggtctgttaaatgtaatactttttcttccagacagaacagacaatgagtggaattttggccaggactagtgctgaggaagctgagtgtccacttccccatggaatcccctgcttcctactctgattacatactccttcactgttcccaaccttcctcctcctcttcccgggattcatctcatctggtgtgctaactccagtccaaaagtctcatgtgactccataattaccagaaatcttttccaaagccgggatggatctctgatcccacacagtgggccagtcatttaattaaatgcattttgttagagtcaaggtttcccaacttgcttgcagatcattgttgagtggtcttttccaactcttcttgcttttccttcgacaacaaaggacaaaatcaagttcaaagaccatatggagtgtgtggcaagacatatgagagcttctctgatggatggactatggcaatttagctgcgccatcaaccaagaagtcatgcctggtcagcacagcagagtggagagcattggttgagtgtctaagtcttgatgctgcatcaactcgctgtgtgactttgggaaaatcgctttccccgctgacacacagggtcctggttagcaagtggggaattcccagggattatagcaactcaaaactctcaagtaaaatctttaaagaaataatttagaagtctccaagcctttgcacattcacttccctaggaagaaccctgtcttattgccatgacaaattcctttattatttttttcaagagttccttcatagtgcttcttctaacaaagttttatgaccctcacatccagagagaagggcctctccttcatgctcatctacaccaccattttttaacttttagtatgttgcacattttatttctcttgcctgtttaccctgctagatcatggacacctgagggtagacactgtgcctttccatctgtttgtcagcagttctctttgttgccagcatctgttgatggctgctgcctatgtcatgttatttgttaattattttgaatatcattcctacatatcatagtgtttagaatagcatacgacctgtcacagattttggaggtaagcaataaaggcattcttgaagtgacttttatgaaatgattagagaccttaattgttatcatcaatttactcattcatttgcccagctggtctgtgaggactccttgaggccaaggactgtgcttttcacctgtacagacccaaagcacttggaggttgattaatgttcctatgaaatgattgactgatcaactaattggctgcataatggaaaatatatgatattagcacacagtcttgggttctatttggcccaactgcttacaatgtgaattaccttgagaaaagcatgtcccctctctgaagctcctcctcttcttcttgggattcatctggtttcctgttttataaaactgagataaaaatctgtaccttgagtacctttcaaaattggtatgaagaccaagtaagagggtgtaagacaaagtgcttagtaagctgggatgccctatgtagagttttttgatgctaaatgatgtagttcccttccccgccccccaccccccaaatcccaacaaaaagctcaatctctgcatagctatattgtgtttatgaaagcacggaacccagcttctatctgaagcacttctgggctttgcaggggctggcagcagggagaggggagttgaagccacctggtgctgtcttgttaaaatattcaaaaggctgcctcttcggaggttgaagggaaagaggaaaagtttaaaaaactagcattgcccaagctaaattagaagatgtggagttgtatatttccaacagagggctcggaggcagttttgatcatgtttaccggtctgagctcaggctgaggtgatgaatacaaatggctcaaaccatcttgggcttaatacaggtcacagagggaatatatagctttgaaatcaatgcaaattgaatttctttctttgattttccacagctgggttggatacttgtgaggaagtataatttgcttgttttccttctctcttaggtttcttaagatttcttttgtggaccacaaagaataacagtggctaacactgattgagtattttctgtgatctaggcactcttgaagcagtttggatgtattaaattatttaatctttacaatgagcctttgggttagtcctatcattgttcccattttgcagatggggggtgtgagacatggagaggttagggaaatgtccagggtgcatgggtaataaatagtagcaagaggattcaaacccaccaagaggactccagctcccagttgtctattattatgggtgctttcttatgtatttaatgtaacaattgcccaaaggcaaagatggcattctttgattcatgaactagattgagtgatttggagcttgcacataaagatctgaggaggcaaggttgtctttggttattttcctttgtccctgtctatttgtgccaatcctggagttttgggattacctagcatgcacttggtttcaaaccttaatttaaccaataatagctacaaaaaggagtaggaccttgggtaaattacttaacacctttcttataagttctccatctgtaaaacgggtacaatgataactgatactccttggagctagtctcaggattaaaagaacaatacttagtcaaatgcttatgccgttgcttgccacattctaagtaatctcaaaatagtggcctttggctattgtagataagtcacttattctactgtgagcctttactttctcatctgtaaaatgatggaaaagataatgtcagaggtatgtttcagaaatgtgctcactaaaataagaagggttaataaaacaaatgtacatgcaaataaaaatatacagctcttttcatcatgggacataagattttcagattgaccgaactgtactagtcaccctgtgtgctctaatattcttcataaatttcccctccatcctgctatacacatgcagtacacatgcacgcacgcacacacacacacacacacacacacagagagagagagctcattgaaatgagtattttactgaagggatgtttagtattgctctgagagagaaatagtttgaacttcctttgaaaagtagaactacatttgcccatccagtcaatagcaggcattattatttttaatcgtctttcaagccttgtacattctgtttctcaggtggaaaaatttaccctatccagagtcagctgggtggtttcacttgcctcagagccagaagctccctcggcagggcctagaggttgatggattggcatcacataggtatttgagtcactctcctccttgggaagtactctgggctggccctttgtcccttacccttcctaaggaggagagtaaattgaccctccttattttagtgagcacatactaggcagtcctaaccttgactacttccttgccccacagccttccaatggtaggggtggtgacaaatatacccacttgtatttgctaataacatgacaaggcattggcattatctcagtcctcacgccaggccattcccctaatacaagtgagaaagctgaggtgaggagggatcaagagacttgctgaaagtcacacagcttgtatgtggtctcacagaaggtccgcatatgaaaattactgagctactgggctcttcaggtttccattacagaaccatctataaagagtattattttatcagttttatggggtacagtggtataaagaagaagctcatgatctgatactagacagatgggatcaatcttagctctaccatttattagtgtttgaccttttttcaatttccttcacttatgtgaccccatcttgtatctgagtctgtaaaagaggagtgagaatacttattttacagggataaaggaagggccatgggaaactgagtaaggattcccaagatgtgtgtttgaatccatggaatctgtgaatattatcttgtatggcaaagaagactttggagttgtgactaagttaaggatcttgaggtggggagactattttgcatatacttaaaagtgtctttataagaggaaggcagagagagatttgactacagaggaggagaaggcagtgtgaccaaggaacagagattggagtgatgtggccacaagccaaggaatgccagcagacaccagaaactgaaagaggcaaagaatggattctcccttggagcccccagaaagaccaggcctgttgacaactggattttagcttactaaaactcacttcagacctctggtctccatagttgtaagagaatacatttctgtgttattaagtcattaagtttgtggtaacttgttagagtagcaatataaaactaatacaagaaataaatgggaaagtatctttgtgttgtgcataacagggccttaaaaacaggaatgcttaacttgaactcatggagatagagagcagaaggatggttaccagagtctgggaaggttctgggaggagggctggggggtggggatggttaataagtacaaaaaataattaggaagagtaaataagatgtagtattttgatagcacaacagggtgactatagtcagtaataatttaaatgtacatttaaaaataactaaaagagtgtaatcggattatttgtaacacaaaggataaatgcttaaggggatgaataccgcattttacatgacatgattattaaacaaaacctctcatgtaccctgtaaatatatacacctactatgtacctacaaaaagtaatgaatttttaaaaatggtaatggttagtattggtccaagagattattttctgggagaaatggcattaacttaccttgaaactggaatgcttttccatagagatgtagttctatgatgtaaatgcacattgctagattttcaagtagttttttttgtcacagctcctttaacatgacattttagttgtaggctgaaagacagagaaggaaagggaagttggagggagttgcaacctccatcattagcccgacagttttgaagtggcctgttgacatgggagctttgcagtgtcgagtggtttagcccacagtgaggagtaaatctggacttatacatgacattcctatcattccagggtcagtctgaacccagcaagtggcaggcttatctgggtccctgctcatccataattcagaggattcacccacagcacactttgacaagtgtgaaaagagctatgagacaatcctgctcaagttagagataagaaaatggggcccaaagcagttgcttgtcttgcccactctgagctaaaatccaggtctgctcatttgtgaaactatgttccacatggaggaagaagcttgcctagattggtgtagaaccagccaaaatcaaaggaatttattgcttaaaaaaaatcctttacacggattgggcttcttcacttagaaaggacataaaaaggggaccgagaggagtaggtgaacacacaccaggctctctactccctctgagcttccgtgagcagtataatgttgcttctctctctctcctgcttttctccggttttggatgtgtgcagtgctctcatcgatgtggctgtggtatcagaggaccaaagaagccccctagtgagatgccaggcaagtttttcagacactgtatcagaaagcagcctctgtaggagaacttcaaagactttctaaatgctttggaacacctgcccaggcccacattgggctcaacttgcagatgaatggtatatggggagtgctcttgggtgaatatagatagatgactcatcgtttgagacagatgatggatttcccttgtggaaatactatataaggaaattatggtgaaagtttgataatccccatggacaggagtgggcaggggccaggatgaatcagtgagacagctgcattgtggaagaccaatccagggaagcttactttgaagtatattttgccagtggctcctttaaactagtaaagtattgccaaggagagatcttccgagagtctggcttaatgagcagaaatcagtcataagtggttgcttttgaaggaagtggaagtactttggcttttagcaagttgcaatcttgtttgctcagttaatctaagaagtaattcatatgaaattgctcctgttcagccatatttgacctacaaaaatgatactttaatatgattaaacttaatacagtataagccctatcaccaaatctgtgacaaagacaaattccagaccagaccttggctaaatttaaaaaggttttgcccaccgtcactcttgcgatggaaagacaggccaggttggtatggggcagggtatttgtgaaggacagtgagttaaccccatgcttgcagttctgacagccatggttggcagatgaatttttttctcccatctgtggatactgtactgatatcaacaccatggtagaacctaggtagagcaggaagacacccaataaaagagatgtcacaagctgatattgtgtatcagagttcaggtttaggcccttagagagccatggagatgaccagatagcaggggtaaaaggcatggtgttcttgagactacacctgggcaaacatgtgaatggatagttgctatctaatgagccccatggaagggaatggagttttacgctatcacttctatgacacaggggatcttctgtaaatagtgattgttaatttttattgagcatttattatgtgctggataccatttttagaactttacatacattaacttcatttaatcttcataacatttctatggatagatactattattagtcccaaatgaaggcatgcgcaagaggaagttacttgatcaataataaatagctggtgtcagatatgggattaggacccaaaactctttacatgttgcacaggatcctcttcactatgttttcctgcagaggatgtttgtattaatccattctatgctgctaataaagacataccagagactggataatttataaaggaaagaggtttaattgactcacagtttcacatggctggggaggcctcacaatcatgatgggaggcgaaggaggagcaaaatagtctcatcttacatggtggcagacaagagagagcatgtgcaggagaactcccccccatccttttttttttttctttttttgagagggagttttgctctgtctcccaggctggagtgcagtggcatgatctcggctcactgcaacctctgtctcccaggttcaagtgattctcctgcctcagcctcccaagtagctgggactacaggcgcatgccaccatacccagctaattttttgtatttttagtagagatggtgtttcaccgtgttagccaggatagtctccatcttctgaccttgtgatctgcccatcttggcctcccaaagtgctgagattacaggcattagccaccgcgcctggcctgggaactcccctttttaaaaccatcagctctcatgagacttattcactatcacgagaacagcatgggaaagacccacccccatgattcaattacctcaccagtctctcccatgacacatgggaattatgggagctacaatttaagatgagatttaggtgcggacatagtcaaaccatatcaatgttttactgctttactttccttgttgaaggaaagaaaaagaagggaaagaaaaagaagaggaagaaaggaaagggcatgataatatttatttgtatttattttgttgactaattcttccaaccatttcttcattgcacttagattgatgggatacacaggccctgtgctaatagctattggcgatatagccacaaacacaacagatgtaatcactttccttttgagcttaccttctagggcaatgtttctcaaccagggatggtttactctctagaggatatttgctaatgtctgcaggcattttggctgtcggagtttggaggtttgctatgggcatcaagtgggcagaggccagagattctactaaaagtctgcaatgcagaggatggtctcccacaacaaataattctttgtcccaaaatgtcaatagtgctgtttgaataatgctgatctagtgaggatgtaggatgttgaatcgtgacaaatatccaacatagagattgaaaagacctgaacttggaccccagaatcactctaacatttatgaccttgggcagaactaacccaacagacatgcaatgggatagtgtgtagagacacaggtttcatgagatgggataaacactctcttctaatgcagtgtcttaggaagtaaggagacttgaactggtcatgccacagagtgcattcagaggggctgtgtcctgagtgagtcaccaggatcccaatatcatatttggagatggaagaagcagagctactcacttctaggggtgcagacccaaaactgaggatatctgccatggccagagaggaatggggcatgcaactggttcctaaatgttctaggccatgtaagacttctagattattgaataaactagtggacaagagaagcaacactcaacacagctgagactgaattttctaccgtcacaaaggagtatggcatggttgaaagaaataaagaagtgagatatatcttaccctcaagtattgtaatgtacccattatgaggagatatatatatctcccagcttctctggccagccacagaaattggtagttttctttctttcaaaagaaaacaattgcagttgaagtaatagctttccctgtttttatgaaagttgcatgatgaggagatgagacccatgggtatgataaactttccaatgcctaagcattctgttttggatgctaacctctagttaggaagtatatacggcttggcttataaactgtttccttcgtatattagatgttcccttctccaaggaccaggatgctgagaccagaggtttaagaatttgtctccaagactcctgagccccttattgctgtctgcctcaagcaatccaatagaaacagctggtttcctttgggtaactgagaagaatgctcaatgtcaaaatcattctccaagccttaaaatatccaacaagatttaaccggtaccttgaacagtggctggctcatactaagcactctataaatatttgttataagaatttatggcagaatctaatcacctttgaggtgctagcttggatatggaaaatttggctcacaactttccttgtaaaagcagccaattaaattcaatacagagttattaattatctacacttttctggaacaataaaaataacagccccaaccttttgttcttggtgattagatgttgtatgagcagggttggcagtagttagggttgccaaagcctggaactataatttttttggaactccaattcagtgggccaatgccccctaaggcatcaatatctttattttacaaatacttgttagattcagacatgtatcacaccttggctgcaagtaatgggaccatgtcatagggattgaaagtgatccatccatggtggcgggcgcctgtaatcccagctactgaggaggctgaggcaggagaatggcatgaacccgggaggcggagcttgcagtgagctgagattgcaccactgcactccagcctgggtgacagagcaagactccatctcaaaaaataaaaataaaaaaataaaaaataaagtgatccatccagccctgaaggagtttataaccaaagaaacagtaattgtaaaacaatgtcataagtgctgcagtacagtcaccataagaggctatgattgggacacaaagagatagagaatcttatatttccattgcttgagtatttttaatgtccgaaaactcattgtcatagaaggaactacagagaaagaaagtgcactaatgtttactatgcattgagcatattttaaataagtacttactatatgccaagtactatgggaggttctgaagaggcagagaataaaagagacaaccattaaacacacaaatacacaaataaacatgtaattccaaagagctatgagtgcaatgaaagaaaagtcaattgcctatgagacactctatattagtttccacttcctggttttagttaatcccatcaatcctgaaataagtattttaatctgtattttgctaaggagtttactgaggcttccagctgtaaagtgttttgccaaaagccacccggctggtaagttttggagctgggattagaagccagaattgtccaacgccaagcccatgcacttcactccaagtcctcataagggagcctcatgagatatgagccaccacattcagagacagtttcactaatttattagaagcatgcttattaaaacgcattctttctattcagcctgttatttactttatactcctttaacatctaccacccatataggggttaattatatactatctcatgttgatttataaatgtggattagtcttgtttaagtaaggacatggaaagtctgattctcccactcaaatccacccaccttctgtctaggctgatgctggatgtagaagttcctattaaatactccctggtttaaagcacagatcttgaaatttttatggtattggatacagactccagagtaatggactaagagaaccaaatggctctgagttcccttaaaatcatgcagagctgtgttcaaatcccatctcagtccttactagctatatgcttctaggcaagactttcacacctctgggcctcagagtccttacctatgacagggagatcagacgcctaccttcagtgttcttttgaggggtcaatgagttaaagcgcttagcaccatgcctaggacacagaaagcactaagtagatggtacttattatcacttctaggttttcctctttattggaaggctctcacctgaaccatcaaagctagctgctcaacttttaattcatttctaaaactacataaggagttggaaacttactgtattctatttttttctggatttttttcccttgcttttaatagaaagggagtctgatttgttccactttttcggtgccagtggttctcgttctcgacggggggcaattttgtcccccattgtttggaaatgactggagacattttgggctgtcacaactaggctgggtggagatgctattgacaactagtgaatggaggtcagggatgctgctgtacctcctacaatgcacagggcagttccccccacacttctcaacaaagaattatccagctgaaaaatgtcaatagtgctgagattgagaaaccctggtttatagcggctagcagaccggagcccgggtgagctccaagatgatgtcatgctgggggagacccacgctggcctgcggtgagacacattacacatgggggatcgcaccatttccttgcagacccctcacctcaccaccgccgccgcctcatatcctgctcaggtccctcctgggaacccagggaaacctcgcagcagatggggtttcgtttagtcacattctctgcagccagattggattacatcgccagcagctctggctctgagagaccaaagttgcttgatgagctctgggctggcctttcaccttccaggacccaagctcaccccaacacacaggaggagaggggcttgtttgtggttctatctctcaaaaggacaaaagctgagaaacagaaaaagccaaaaggatattggtatcttctgttgaaaatggtgcctggatatttctgtctttatttcttgtgtttattatgacaggtgataaatattccgtagtctttttgaagaaatatataaattatagagatctccagggcgtctgtatttcatacgtgtctttgttataggctgttagaacaccacagactgggtggcttataaacaatataaatgttatttcttatagttctggaggctgggaagttcaggatcaaggtaccagcaaattcagtgtttggtgaggacctgcttcctggttcatagacagccatattcttgctgtgtcctcacttgacagaagggacaagaaagctctctgagccctttttcatgagggcattaattccttcatgagggcactgccctcaccaccttcctgccggtggttccacctctaactaccatcacattggggattatatttcaacataattttagggggatacaaatattcagcctatagcaatgtaaaagagtcaaaatggctattaatttttgagcagttataataacataagtactgtgttatgtgtttaacaagtattgcctcatgtaattctaaaacgatgatgtgtagattagcttctccacttgaaagcagatgtaatggaagatcagcaaagctggctcacttcagggccacagctactaagtggaaaagccaggattcctactcctctctcacttcctgcaagacctaagtcttaaccactaagccagatgcttcttactaaatggtttagtttggttcgagtgagaagatagctaatgttttgcagaaagcatgactaatccaagatcttccagcaactgaggagtgatggaagcatttctgattcctcttgttgttgctctttagcaaatgggtgaaacaggtaaaatgagttaccaaagcctctcatctctcacctgggcatgaattctatgcctttccaatatacacatgctgcctcctgcctcaaattccaggtgttcccttttactagatactacgctaggaaccagggacctaaacattcagtacctgctcttcaagaagcttacagtcaagtgtgaaaacaagacaaggaacaatgttattacaatgcagcagaataaatcctgtgactgaggtaggtacatgctagatgtaggttgtctaacccaggctatagggaggattagctgatttatctctgagttttgaaacatcctcaaagcaaagtagtttgggaaggataatctggtagaatatacagcatatgcaaaagcaaagaggcatagaagagacttcaggagcagtgagtagtttgggagagatgggcacatgatccataggggagagatcatgatgagtactgtgtgctaagcagtgtgcatttattcggtttttctgacctcccaaaaataacaatgtccacttaggaatagagattttcacaatatacaagggaactgcccacagctaacccttatgagaacttgctggtcttccatagggatttcggcaccaccagccaccccagtgtgcttggcactaggttagggacttctagtcaagtgatccttgaggccgtagtccacatacaacatctgctacacattctagtctctcatggctatgatgcatgccggagtgggcactgattctctacctacttaggtacgattctgttttgccaaggattctcctatacaatgatgtccttcctccctccatgctcagggaactagatagctgtttcctttcttcagagaggaagatagactcactgtatagttactatgaagagatttagcaccttcccgccaccagcatctatggaagatacaggggatgaggattctttgggaactagaatctaaacttctcgtttgtaagctatttttggataggaagcagagccacatggaaaagatttgataatgttaacaaatgacacaataatgactagcgaagccaggaagtgtttctttttatgctcaaatgatgcacttcagttacatagacttctgagaagatagccttcccattctatctaaaatgccattacatcttctaatatgcaacaaaatgccacctgatccataaatcattcctccatatttagcccagaataccgctttatattttagttttatctctattccttgattaccctactttgccaggatcctaagtaattgctttcttatgttcccctctcatgagattataaaataaggagagcaacatttattatgaacctctatgtggcaggcactgggataattgttttataaattcttgttcatggaatcttcccaaattgactatgggcagatgttaccagccccatattaaaaataaaactgggtgtgatggcatgttcctgtactcctgtgactcagaaggctgaggtgggaggatcgcatgagcccaggagttcaagtctagcctgggcaacatagcaagaccctgtctctgaaaaaaaaaataacaaaaatgagtaaaatggaggttctgagattttaaactcctggagggcttaaaatttatgcctttatttagctctgtatgctccaccaacgtgacataacagttctctgaatatggtaagaacaaagtgagttttattgaaattcttggactatttcttttccctactgaagtaaggcaatctccatccaaggttcatcttatattaaaaaaaaatatgctaggaaatctcaacagtgttgtatcaaaggagtcagagcattaaatattttgggctcctgccacaggcatttactgtgaagtaaaggacatgtattgttctgtgcttcatcgtgatagaaagaacgccagcgacgtcatgaaatattttaggatcagatttgcaacactgtgcttccaaacagctgtgtgtcacaatgaggggcagggcctgggcatctgggccaccggtgttcggctccttctcttcttctctcttgacctttagcagactccgtgtctctttcctttgatggaacagctaatgaaacacatcctttccttgagtcaatccctgatttcagaaaaatttttagacatctgtgtgtgtgtgtgtgtgtgtgtgtgtatgtgtgtgtgtgtgtgtgtgtgtatgttggggggatggagggaagagtgaggaaatagtttccattcagtagtctggagcctgatctattggaaaatccccaccccccaaaaggaaatgctacaagagctcttctttcacagagtttggagtggattcttttctgttgtgaagtgcagatgtgaaaaattcacctgttctcacctatggtcagacagactgttcagacttttaaaactgtggcaggagcatttgctagccctagttgccaatgagctggatatgtgggtttcccccactaaacggaacttggtcttatggcaattataaagccacattgaccatacttgaaagagagaggctgggggtggccctaatgagttaatggcaatgttcaagttcacttaacttttgtaatcatccagtttgcaaatgcatagcatctactaggagaatgtataatattcattaggagttaaagatgataatgagaatatttattcatttgtttaacacctatttgcctgtctcttgctatgcattgagtattgtgctgggaagtgaggaatttagatgaaccagggggtttgtccttaaggggctcatagcttagaacaggagacagacaagcaaagtgacaatggtaacccattgtgatcaatgtcattaaagggaaagtacaggatttaggaactaatagtggctcagggtgtggggaaggaaggcttgctagagaggattacacttgaacagaatcttgaatatgatttagagcttgggaggaaaagggaagaaaggaggcagtgggagagaggcagagatgtctatccataccagagtgtgaagaggagaaacagcatgctgcatttggggaaagtccatggagtgagggtcaggaatggagggagggtttggatgagacagatgaaattggcagaatctcatgtaggaccttgagagccctgggaaggattttgaactcttcttttctagaaaagttataggaggccatttttggatgtcaacaaggaggaataaagatagatttgtgcttgaaaaatatcatcttggctataattgtgaagcagaattgcaagcagattggagttggagagaccagcaaggggctgctgtagtcatttaagcaagaaaggatggtggctcaaaccagggtgggagttgcagggatggagggaattgggcagagtctagtgatattaaagacaaacttgcaagggtttggtgattgatgggatatgggtaaagagtagagagaagtaatatcctgaaatggaattggcaggtagggagaagagggagaagtgactgttgtttgggcctggtagttccagcttaggaatagaggcaatcgaaacaaaaaaattctgttgtagacctggcctcagcaggaaaccgtgcctgtgctctccttatctccagacttggcctgccagcacatacatatatcaccctctcacttaagatggagctaacagcaggcaaagttcatctcttagaggcccttaccctattggtttggcatgtctttattctcacagtccacagcagtaaaataataatattgcttacagagggatggcaccatggttaagtgcatgtaagtcagactgctggatttgtaaataggctcattcttaattagctatgtgagcttggacaagttactgaagccatctgtgattcagtgtccactttgataaagtaggggccatagctcttatttgacaaatttgtttaagagaaaaaaaaaagcagaattatatgtacatgagtaggcacctgataaatactgataaaacaaatgaatagttcttaccttattcttggttcattttctcttctcagtatataatactggatgcactttgtcttggggattcagagccctgctttctttaagggagaaagggaagttgaaaggtcaattaaagttttttggagaatctgtatcctgtgctgcattaggcatttttctcatgtcctctaacctcggattatcattctaaagtctttatctcatcatgttccttcctgttgcccaaaggatcaagttcaattttcaaatgttgagtaaggctttctagagtctgaatgtttgtgtcctctccaagttcatgttgaaaccaaatcctcaatgtgatggtatttggaggtggggcctttgaaaggtgattaagtcatgaggtggagtcctcatgaatgggactaatgccttcataaaagagaccccagatagccgcctttcttcttccactatataagggcacagcaagaagacaccaggaaggggccctcactagacactgaatctactgctgccttaatcttggacttcccagcctctagaactgtgagcaatacatttctgttgtttataagccacccactgtatggtattccgttacagccacctgaaaagactaagacaactttcatggccctttgtgacctatccccaacttgcttctttagccttatctcctgcctccacctgctaggtgctgactctaccctctgctttagatatgatatattttctatttatcaaaatgtcatgaccacatatggccccatgctaaaatgtgtgctgtaccttctgctgggactgtcctcagttcttactccttaattaaggctttgctcaaatattaccacctcttatagaattgatcattctatcctctgatccctggaaccttgagttttttctaatatagagcttattgcagagcatctcaattatttgttgagttcatctttcccttagtaaactgtgactcttcaagggaaaaacctgtaccttcttggccttggtagcccccaatcctaacccagaacgtggcgcagagtaagtgtttaggaaaactttactgaatgaatcagtggataagcagattcaagttaaaactgaaacaacagtaggtagatgacataccttttttcctcccaccaccttcttgctttgccttgccttcaccccagctcagcaatctgctcagaaaagagagcatcagaactgaccaaaaaaggaaggaatatcctaagaaatgatgcagctacatattgcttggcttgtgtttcctagataaggcattgattcctaggcactagaattatatactataattaaagagatttttttttaaatctatcaacaaagacctagagtttgaaaatctttcagttttctaatccaaattagggaaccagttacacagggtagcataggtcaaagggtagggctataagacctggattggctggctgaggataaataaggaagtgtagacttagtccaattgcagcccaaacttgacgtgtaacatttatacttagaaaatgtgtcattctcacgtcctttatacagatttgtccatcagtacattggattttcttaaacaactaccatttgattcccctattataattattgaagtgaattcactctgataaaatacagtccttagtagttcgctttaatgctctctaaaatattcttggaaaaatatgaacgtttttaagttgacaagtgcttttattataaaagtttaaatagttgtgagggatataatgtaaagtatattgaatatatagtcatttaaaataaaactaactattataaatagatttaatggattgaaattccactttaatttgataccaccattcatccatttaaaaatatacaagtagaatcttccctaacagttgaaaacttacatagttcttttgttttccttaaatgtttatttccatttcatttgctctatagaaatgtttcctaatgtagtatatttttttatactggaaattctttcactgatcatgttgttatattattctgaaacaaaacatgtatataaattcatattaaaatttctttaatgttctgtaaatataagatgctaacaaaacccaatttcttctggattaaattatcataacaattattagatgtatacaactgatcaatctaccatacacttattaaaattttgctaaatgtgatgtgaaacataaggttttattagaaatgcttctctgaatgaggtgaactttttaaaaaattaggccatatgtctgctgaggaatattcattattgctaacgtgagatggtatttcataaattttatttacttttcattttttggttgtaagcactgagaaacctattcacaaaaataagtagatgggaaaagaaaaacttttcttatagcagtgttataacttcttaccaggttgtatgccaaaaatcacataaagatcaatcatcaaataggatttttaatactttctcaggtgacattttaattaggttccccttcagttttgttgtaactaaagcattgaaagtcatctgacttgcagaatgatttgctgcaaggtcattagtcattcactttctcaacactttttctcgaaagaattttgagttgtacctttgtttggtcccccagaaatttttataccccaaagcaactcgagatgagtgagaggtatgaattccatttgtaaagtgagagaaaagcatttacgaaaaagggactctcttcagattcctgagaaagagtgcaaatgaaagctgagaatctgaaaatttccttatctctgccaactagagcccatggaaaatctttgagtaactctgggggtactatgcatcacagtctgaaaattattatatgggatgtactttctatacttaaattaaatttccccatggaggcagcattgttatacaggtgacaatgagataacaatgcaaagaaaccagaagtcaagttcatatcgacttatatagctctgtctccataagtcagaaacaggaaaaattaacttgttcttcagcaatctaggttgacttcatgaacgagctggcgttcaaatgaatccttgaattgtggaaacagaatgttaaatctggaatgaacttcagatatcatctagtatggagaggacaattaaatgttgacttttacatcaatttggattaaatatttgtgattgcttacaattctgtgtcaagaagtagtcagaggaatcatctgagatctgtaggaaagcatgttgtgattgattagctatgcctgtcagaggaagcagggagagaggggcacaggtgatctgctcttgcccccctaggtacatagtccttatcacatgaaccacagggaaaactgaggctgactgagagcaggaagcttgaccaaaactccacagtgaattattgccaggatgggtagaattacatatgttttattcaacatttggtggtcattgtaaatttggtaacatttgcaactggaaaatttggggatgttttagagctggaagggagcaaattcttaattgagcaatacacgctgtcctttctttcaggctccttcacatttgatctctgtgcaatttgataagaggagggaatgggccgtcaattatgaagagactgaaaacctgaaaatactgagtatggtcttagttccctctccaaagggagctcaggaaaaatgccaagccatacaagccactgattactcatctagctattgtttctacctcaccctggcccaggaagacagatctactgaggaaaggtaatagaggctggcaaggttcctacttttacatctatctgtaatatccactcattcttagcatcttgcacatccacagggccgtacaggagtcttcttgccttgtattattgaatcttgggataggggtaggaacagacagaggtattagcagagatccaacaggatgtaaaacatacatgttgatgcaggggttaactttatgtataataaatagatttttaccatgcataccaaactgaatattccttcctcctttttctctcagacctctttctatgtgtggctcattcttttactctacaacataatgttcagttgattctggactttttctgtgacaaacaatgctgtaataaacatcctccttgtgcattcatctgggtgcacttctgagaatttatctgaaggataaattcctagaagtagactgtctgtaacatagggtctatgcactttcaatttccatagattctgccaaatggttttcttaagaggttataccaatttacactctcagctatggtatatggtaacccctgctttcccacaacctgccaacactgggtatttacaaacataaataaatggagggtttgaataattgtagttttgaattagacttggggcgtccctctcatctgccccaacttgtgtctccccaaagcaacctaactaggggatggctaatgccatagactctgaggcttactcagagcagaggctgaatgctcctgcttcagtgggaacagggggtgtttcttcagtctgtgccctacttggcatctgtccctgacagacccagccagtgtggggagccagcctctctaaccataagaaagaatggattggaaacaaattgatcttttcacagctggctgttcccctctttcccctcaacttggactcagctcagaacaaggttgccgatgttctgctgcaacaaagatggcattattgaggactgcctctttggggggaaatgtccttctccaagaatcgcctctgtagtttcaactatgacaagcctggagaccgagcatagctgtgcatctccaagggtctccaaagcgacacccaactctatccgtcctgttgatgaccatgtactcttctattggtgtccacaactttatttaaatgatgtcagatgactcaattcaacagaatctaaccctttattcatcctccctggagacctgtggtcagtgggcaggagagtttgggattcaaaaagaggagaactgtgtgaacacagggaaaaaggatctagtgtttatttctagcaacaccattactattgctgtccatcctattattctgcattcttttgcttcatagcatttttttaactgaaagaaatggctccacgaaggcagaaatattgtttagtttaaaactgcatcatcagttcctagaatacctccttatacattggaggtgcttgatacctatttattgaatggatgaatgaatttcatgagcacctgtgttggacaatttaatgtacatgatgatatttaatattttaactctgtggggtatatatattatctttatttatagctaacgaaattgggtctcagagattaagtaatgcttccagaaccacacaactggtaattggtaaaactgagatttcatttagacctgactgatcccaaacctatcttttagaacactgggattccagtttatctaagcttaagctcaaaagtattaaaatattttgcaatcaatgagggaagttgtcatcaaggacatttccaggtgagcatggtgtgttcaacaggaagagaaactcctccatactcccaccaaagtgagcaagtaccaaaatgttaagtgttaattaaatcttattcatctggggacaagcagtagggtgaatttatatgcatgtagcaccgattttgagctaagtaacaaggggattctgaaagacccttatgcggacaatgagtgaatgtaggcaagggcactaatatttaacaaagttatgctgtgtgctaggaaccatgctttaaatttatgattccacttaatcattataataatttcctttctttcctcttttattgtcttgcccttcccttcccttcccccttctctccccttcccttcctctttccctcccctttcattccctttgtccttcccttcccccttcccttctcttcccttcctgtcccccttctcttctcttctcttccctctttctccttctcaccctcccctcccctcccctccctttccctctccttccctccctttccctccctttcccttccctcccctcccctccccttcccttttctacccttcccctctcttctcttcccttcccttcccttcctctcccttcccccttcccttcccttcccttccaccttctcctctctcctctcctctcctcccctccccttcccttctccccttcccttcccttctcccctccactcccctccccttctcctttcccttcccttttcccctcccttctcccctcccctccccttctccttttcctccccttccctccccttctcttcccttccctttcctctacccccttccccctttcccttcacttacccttatttcttttctttctttttctttgtttctccctccctctctcctcttttttcttttctcctttctttccttcctttctcctttttttcccttctttctttttaaattcccagacaagaattttgaagttcagctaaggtaagccacgcatagtgacggaaccagcattcagatttacatctcttgctacccatcatgtcacatagtgttaggcagagactggggtctcagttgcctaagtaaagtcataggcatgaagggtgctgcaggaatgactgagtggcaggctcctgacagcctggttgatagaccccaaggactacttgggttttggcgccatgcctagtatgactttatcctttaactgtttctcttgtcagtcagccccctgagggagccctgtctcctccttgaaactgtactataatgagaggtctccacaagggttccagaaagccacacagtgtgctgtggttttcccgagaactggctccaaggtagtgctctgagatcagtccttccagctcccatctcaaagatcttcaaactccaggctctcaagggttttgagctgccagttatgatgaaatattagcacagaagaaaataatttttttttctattctgtgtttcttaccaggacaccatggtttcagaatgatttatatactttgaatattttcaaaaaatttctttcaatgttgttccttctttaggtatttctcttatcacttgggctcagcttgatgcttctctggaatttttcttttttttttcctcccatttataaaataccaaacatgtgtccccagtctggatccatgtaactgaaaatcatggggaaattctttatgtaaaaagccctatagattgtttcggacaaaatcaaccccaaagagtttgtccccacaatatttgtgaataaaatcatccctctgaaataaaaacaccaccttaaataaaggagttcctctcaagcattttactctatatttattgtttgttcattcatgccatcatttgaaaaatactaattaagtatttaccctgtgttggtaattgtgctgggcacaaagaacataatagtaaatcacataaaattccatcctcaaggatcccatgttctatcatactagagaactgagtacagctgctcctcgacttatggtgggattacatcccaataaacccatcataagttaaacctatcataagtcaaaaatgcatttaatacacctaacccactgaacatcacagcacagacaatgtcaggcactttattacatgtagtaaagttgacatgactcttaatcctactaacaaccctaggagatagattctgttattattaccatttcatgatttaggaagctgagaatcagagaggttagtggctggggttgaaattcaagtagtacagtgtaagagcctttgcttctcctagaggctctgtaaaggtctgttgaataactgagtagacgatagattgattgcaatatagttcctctgttgcctttttgaagtgttagtttagtaagcaaccacagagaaattattatctactagagatgggaataggaacggtttcctaaatcagggttggccaatagtctttagttcaaactaaaagccatcacttctgcaacattatgtgtcaagcatgagctatatgacatgaaagataaagtgatgtagcaaatgtattcataattcagcaatatgagattatgagaaggagcatattcctgtgcactcactctgaggtcaaaggagacacccattttcctcttgagggaaatagtgagaggtgtttacctgaaggcccctggtttgtgctcccccatagctggggagagggagctgctgccgccctttccagtaggagttgtatattctataatgtccttatcacaattcctttaagggcctccagcactttggaagcatagaaaaaagaaacaacattcctgcatcgcggggccattgatgaataagaatgtttataagaaggcaagcatctttgcactctatacatttccaaatcttttagaaacatatctaagaacttcttagttcccctccatggttactggatctacaaacttggaatttccccattggccctctgattgtatttggagtctgttcttcatcttgtggatcctctgggctctgtcttgaactgttggaacattttgctcccacagctgttggaagtgacccattaaggtagccagagtcagtcactcagcatcttaatggcaagaccaaaaggggtgaaagaaatagaagtcacggttagtaagcgactgacctcattctgcaggaattctttctggaaagagagcagtagaatgttgtgacaggcagtaagtcatctgtaagaatgtttaccgtggaattctagcaaaagaaatggctcaagaaacttcctgggtaacacaaatagagtctgctcagaggccccaaaagagagtgactggaaaactttagccttgtgagggaggctgtctactccagtgttggagtcagctggaggtgcagcagcgcttgagctatccaaactgctaggatgttgttaataaaagaaccttctcgttctcgagtcaacatggctaaaacagccagccatgagatgtatgggaaagaagtgcagagcaagttgttatttattgaatgtgtagttaggaattactatttccatttcatggaggcttaagtagattgagaaatttgtctgagttcacaaagtttgttaagtttcagactctgggtttagacccatgtgtttctgactccaaatcctgcatggttggcttttgtgagagcaaggttacacactgtacacattttttttcctccattgcaccattcactgtcctaggtatatagaatcctggaacacaggattggaaggacctttaggcatcccatggtctaatcttctcatggtacagatgagaatgggctcagagaagggaagggccttgctcagactcacacaaaggctagggccagaatagatggtgcctgactctcagttcaggatgcttattctgacaaggcccgtcacttcacatggatatttaatgtattttgctagttggttaaaaataatgtaatgtatggcagaaccatctctctttcttcaaggtaagccattgctaagtctcgagtccttttttgtcccacagctccttttttcattgattattatcatttggtctataaagcctttcaccttcatttcagtgaacaatactgctgtgggagacactggagatgcaaagataaatcagtcctggttcatgagcttcaggaacttaggagcagtttggagagtcagatatgagaacagcttgttttcatacattattacacaatcatatgtaatatatagctggggggatatagaagtgaatatgagaagacctaccccaacctgggaaattagaggagtcttcctgtcttcctggaggattaattgattaaagtgactcattatttcattcctacaacaaatatttagcagacacctcttctgtgtcagatactcttccagttattaagggatgcagcactaagaaagcaaaaatattcctcaccttcatgggagaaatgcaacaagtgtaactaaacaaaatattactcaagtttgcagcagtgacaggcccataacaaggcaaaggtctacagactaatattgggttgaagatttatttttacaagggtggccagggaaggcctcttcaaggggaagtcttttgatcaaagaactaaagcaagtgacagggaagaaccttgcaaatatctgcttcccaggcagagtaaaaaccaggaccaatgtcttaagtcaggaaccagcttgatgtatttgaaaaagagcaaaagccaggcgtctgtagtcccagctacttgggaggctgtggcagaatggtgtgaaccccggaggcagagcttgcagtgagccgagatagcgccactgcactccagtccagcctgggtgacagagcgagactccatcaaaaaaagaaagaaacaaagaaagaaagaaagaaaaaaagaaacaaagaaagaaaaagagcaaaagccagtagggatggaggagagttattgaggttactgcaggaggagatggagatacagacatagacaatgaccagattgcagatgttgtgcaagtcacaggtgagtaggtcttgtcaataatttccctcctggtcagcattgctggcaatactatggcatcatgcatagagaaagaaaaagctaatagcaaatgaatcactctgatcatgcatcttgagatgttgccatggattacaattaatgcgttcctatccacaaggccagattccctcaaagcatctttttgggaaatgcagcgagctctcctggccccagcactcccacccaccccatcacacaccctacattcatcatctctttctctgtttctttgtcatgttgctaacatcccttgatggagatggtgcaactccaagtaaaactgtctccataaatatttagactgaatagaaaatgtgccaaagatgcaaataatctgtccagagggagaagagacctttctctttgttgttttcttcaggcttgtaatttaattcgtggatacatgtctttgaataatacataactatcaatttacctaaaagagtcccatagaaaccttagcctcttcatccttctgccatgcccctcatggcattttcttcttacgctggagtatacatttctctgcttttcttttatccctttctttcttctttattcccatgtttttgatcacatactgtgtgtcagcctctgttaagctcatctgtgcagagtctatactcactgcctgtcctcctctcatagtcacttgtcaattcattttcattagccttctccctccaccctcctttcctgagtctgttcccactgaggtcaacccagtgttcatattactgaacccagtggccatctttctgtttcttcttttaccagacctcttcactgaactagataatgttaattagtcctggctggagcgcaagtctcctttgacatctatttgcactgttcctctgcttgaaccactctgtctattccttctctgtcccttaaatttttggcttcttgtgggttgggtttttggtattcttctttgtctagcaccacccttgcttgccatcgtgccctcattcaggcctgggctttgacttgaatagcttctgaatctctatgctctgcctgtattggatagctggcaggctatgggcatgggctgctaggtcccagacaactcacactctcatctgataagtgggttttaatgtgacccttgttgtacctccttatttctatttcagtctcacttactgcttcctctttatctgttttcaagtcttcctactagatatttccttaagaaggcagagaaaccgtgctctcttagtaattgcacaattgaaattattcctcttgaatatttgatgatgacatattttgacttgatatagctttttcaatcttacaggaattctaaagctggaggaatgtttaaactccttccagctgccagtttcacgtaaagaactcttttctaaacctggggatatgagggactcttacattctcctttaatcaaatcaatttaggctgaaaagaaggccaagttgacagccagcatttcactgctggctgtgtatccatatacgtatgtatggatgcttagaaaagtggaatgctagtgatatatatatatatgcatatatatatacatatatctatatatatagacatatttctgctttactaggtgagaagagttgcttgattttaagggctctcaatcaacaggcaccaaatgaacttacagcttgcaaaaatataaagcgctcaaggccgtacagacaaaggtaagggggcacagacctttcagttgtctacaggtattatcatctgaaattgacatacgaagaaagaaggtcagagaagaaatgtgacatgcccaaggcaatccaactgaaaaaatagccaatgtggacaataatcccagtttatagcttctagtgcaatgacttttgccagcacccagcatatcagaagataaacccactgactttctttagtgaagattgcgaattgtttaaatcagagcatgtgtgcaaagtccagggtactatctaattcaacacttctgtaatttgaaagctaataattataagaattattgtccttgtccaactgttccttatactatttcattgttggttaatacattgaaaattacgaaaccttatttttgattggaagagtggtataacttctcttaggaattatactactagtatcctagtgaattatgaattcctacacttaaggaagcacaattataatagcattgtttttctttacttttgccaataaatcagtaagtactgcatgactacattctgctaaaacttaatagttgatgtggaagggaacttactccttattccatatagagacactgtagagtccctggaaatgctggctctcctccctcttctcatctgcccccagcaggggagaaatgagtttatgtattcaattgatgagttttggagctgctgaatatacttagctcaatgttcttattgtggtctccggactagcagcattaatagcgtgaagcaacgtgttagaaatgcagattctcaggccccactccaggctcctgaaccagaaactctggagatgggcccagccatctgtgtgttaacaagcccaccatatggtcctgatgaccatttgagtttgagaaccactagttagctggttccttcatcctctgtggacctgcctgctcacagagaggctgtgtctgttttctgccttgtggttaaaaaaagggtctgcctgttggagttggggaaggacatgcagctatgcagtgctgtccttgaataggtgttcctgtatgctaatttcaggtgcactgttggaaagcccatgatttcagatacctaaaccatgttctccaaccaaaccttatctaatgaagatgacattttaattcccttgtttaaatatgactctaatttcaaagtaggaagttggttctgactttgtgggtgagaagaggatatggtgtctaaacatgtgccccttaaaaccaccataatagccaattacttattctttatggccatatgtcaggtatattttaaagttggaaggagctttggagtggtctagctgactttatagctgctggcaactgaagtccagaaatgggaaggcattttctcaaagtcactcagaaagtaactggagatagcaggctcccagtcctgggctcagacccacacatccagccaacataaccatggtgcactttaaccaattccaagttgaaacagaggaaatgcatatttggagcaatttatctcatcacattaaagatttcctaatttacatttctgcccggtaatcatggatgcctctgtatctaccccatggtcccctggtgaatatggcctctctcaatgtcaggtccttgtattcctgccctagcttcttgcatccaccttccttgacaggaactgaaaatgaattgcagctgttcatcatctctatggaggggaccaatttcttactcctaaactgagctcatcccagggaaaacacatagggcaatgaggaattcctcttaactatgacactaaactaccccttgtttttttttagtcgtttatattttcagtctacagtctaattatttctccaaattgggttacttgatcacctgccaaagacagtttctattcattaacaaatcttggccttcagaattatattttcaccaatctaattttcattggcattatgcttttctgttttctgactcctcttatcggttgtctacttgtatgcatttttcatgttcaaaagtttcatagcagctcctcctcactttgatgctagggaccaaccaatttatctctacttttatggcttgatattgccagctaatctttattgtgtaattactatagccagaaaaaatgttaagtgttttatatgttagcttaactgattctcactgcaatctatgaagcaggtactgttataatttctattttttagatgaacaactgagacacagtgaagctatgtaacctttctaagattacccaactagtaagtggtggagtcaacatctgagctttggttatctgagcccataaattgcccgttagccctgcgttatactatgatcatgcacaggggtctggaaaatgccttgatgttatactttccttcttcttttttttttttttttttttttttttttttgacagagtctcgcactgtcacctgggctggagtgcagtgacgcgatcttggctcactataacctccgcctcctgggttcacgtgattttcctgcctcagcctcccaagtagctgggattacaggcacctgccaccaaacctggctgattttttttttatttttagtagagacagggtttcactatgttggccagactggtctcgaactcctgacctcgtgatccgcccacctcagcctcccaaagtgctgggattacaggcatgagccaccgtgcccggtctatactttccctcttgaaacaccattcctttctttgttcaggatctactgtggcaagcatttgagctcaggtcatgggtctccaaagccattttacacaatgatacgtgtgatggttttctgggatggcccagctagcaggtgggggagggatcactgaggtaggggacagtgtaattgacaggcttcatagaagctaagcaagggacacatttagttcaagttcagtggcaaggggaaaaaaactaatgattgggagatgcttaggtgttttctagtagtgtacaacaactaaaacttatccccatagacaactcttgggtctgaagatacccagcaatacagagtatgtggtagaccctggagatcctgctgctcaccctgtgttccagattggccccaggtcataggaaggtccctggaagtccacagaaaggattctcaagttctggtagggggaaatttcaaatgtatgcaacccatagaaaatggattctttggggacacctacagaaatcaaagatctaggcagaatttgttcctaggatctaagaattgtagggttaataaaactagctgtttatagaaaatttatgtaacttgttttactgatccaggcagaatggatccagagtttgtgttctggcatacagactaaactttaggagggatataatgactgagttgaatcttgaaatgttagtaggaggtagacaatgcaggaagatggtaaaggttgatgttccaaaaatgaacaacttatttcctggtatcagttaggatgtgtttggttgccactgacagaaaaatctgactagcaatgggtaaaacaactctgagtttattttttcacttattaagaaatctggccctaacaatatcaactaatatcaaagttggtatctgtatttgatttgatttttcatgagcatctcatttggcagtcacagttttggacatttcactcaaatcaggaggaagggggatgagtggcattacctacacgcaatcctctttatcagaaaaggaaaagtttttttcaaaatacccagaaaatttccacttgttcaggctcaaataatgtagccatttctggttgcttttccagattctaaggactgtgtgttaagttaggttagccaactgacagtcttccatcacccctgccatcccggaagatttatgaattcagagttggtgtttgctctttgtttatttcttcttagtagagagcacagtgtcatgcccaaagaagggataacacaaaacattcattgcaagaataaataaattcagttaatctcaaaaggcatttattatgcagtgtgacctgcatgccaggaactgtataggtacagatcaaggaacatagagcccagggactggtgaacagatactcaacatatacatgttccaatatgccatggtacatgttaggacatagaaacacataggggcttttcaagggaacccagagtgggaacacacggcccatgttagagggctgaagaaggaggacaaaaagggagtcagtcaggatagtttcaattatgcttaggtaacaaatgatccctaaaccttaatgtgcagctacaactttcaactccctactgtgctatgtggccatgttgcttagctgtggctctgttccacttcagtctctgcctagggcccaagctgactgagcagcctctatctggaactctgtcagatggaccagagaatatagcaaccacacattggctcttagaagcatcttcctagaagtgacacacatcacttctgcttatgcttccttggccaaaacaagtcttgtgaatctaccagaattgaacaggatgaaggtatataatcctccatgtgaggggcacaggatagaggcacaggataggtgagcagtaatatcatctcctacaaacagcaaggacagggcctaactggcggtgctctctgctccttctggtttacctccccgtctttctcctttcactagtgaccagctgtcaacctcacttagtgtgggagagctgtgagctgggctgagtcgccggggatgagttggaggagccaggagactgacttcatctccacctggtccaggaagggagactgagggaaggggcctggatccagagctggaaagatcttggcaggatgtggctttttaggaggtagaaagatggatttcaccatctgtctctttcctaatgtttggaggggtgttctcccgggatatagaggctggtggcccagatttctgagacatctttgtcagccagcactggctcagcacatatcaattgtgaagatcaactcctggcaagtgtggagtttggcatctacaggggccagtaggggagtgaaccagggatagggacaatgaccagaatccttacttgttgtcagtggaaataaacacgcataaatttgtctttagcacacgaagacccaggataagacccgttcgacctgcctatatggagccttgggtgagagatcatcttagatttttctgccaccttaaggtatttcaaactcccttatcttaaccctgcctgccagctgtgtttgtggaccctgcattcaaatcctcctttaaaatgctatttggaaaataagctttaagatcaactgtttttaagatacaaactcaggcttctgtctgtaggcaccaaaaatcatgccctggacttctagcatcaaggtagttagaatacctgttaagaatacatggaattggccaggcacagtggctcatgcctgtaatcccaccactttgggaggccaaggcgggcagatcacaaggtcaggagtttgagaccagcctggccagtatggtgaaaccccgtctctactaaatacacaaaaattagccgggtgtgatgttgggcacctgtagtcccagctacttgggaggctgaggcaggagaattgcttcaacccgggaagcagaggttgcaatgagctgagattgcgccactgtgctccagcctagaggacagggtgagattccttctcaaaaaaaaaaaaaaaaaaaaaacatgaaatttagttttatttctggctctgaagctttcttggaccatcaggcactcattaacttctctgagtctcatttttcccatctgttgaatggagatgctgatcatagctctcctgcttaccttaaaggactactgggggaattcagtgagagcctttacttactgaacatctactgtaaagtagacattggctttaagacaagtgggaacacattgtcatttataagatttatgtaaagtaaataaaagaaatttttattgttgtagttattctattggagaaaattaaagttgggtatacaatcacggactgtacctgattaattcttgcatctgattcttatgcctctgtcttcagaatatttgtaataatctacaattgtccattttggactgtgaatcttttgaagttgaaattaccttttcttaggttggcagtgtttctcacctggattatggcagtatcctcttatcttgcctctctgccctcagtctcagctgctccaatccattctatgcatagcagacaactataaagatatttcacttctgctgaaaatccttccattgctttatgctcttctgagacatctacttttttagactctctttagagaatctttaaatcctagcctctgatagtttctccaggcatatctctcaacacatctcttcctaccccactaatacagtcatgtgcattcccacagagaagcccaaaatcaatattggagtctctctgaaatacctgaatccttaatgaggtcccagcaccttggacctttgcatagttttggctagaacatctttgttcctgtgacttcccacttaggttcaactccaaaatatctctcagatttcaacttgaaagtcccttcacttcctctggggaatcttgcatgatattccttttttttctttttccttcctagctcattatcaaacctgacatctagtaattgtagttgctattaggcagtgtctgtttcatttttaggtggttactagactttgagctctttgaagacagggattgagtctcactcatattctcttttcttgaattctttcctttcttccataaatagtacgtgattttccactttgggccaggcacagtattcttaacgtgctcatatcttcatgcctaatatggtgcctggtacaaagcaagcaataaacatgaatgatggaatgagtcaaccagtgaatcaaaggtttagttcaaacaagttaagccctccctatggtctaggagcttcgagaggatcaacaccttttctaacttttgctttttaccatattctagttccttttttgtttcaccctctgacagagagaagctgagtgggaacaggctgccacatttttgtaggatatatcatccaactggtgaatcacccaggcccttgatttggcttactatttaacttttttttttttcttttttttttttagatgggctgtcactctgtcaacctaggctagagtgcagtggtgcaactttggcctgctgcagcttcaacctcatgtgctcaagcaatcctgctacctcagcctccagagtatgggactacaggtacagtccagcatggcaggataatttttatatattttgtagagacggggtctgtctttgttttccaggctggtctcgaattactgggttcaagcaatcctccggcctcagcctccaaaagtgctgggattataggcatgaaccaccatgctcggcctatttgaccattttaatgttcttattaacttgctctcctgggtggtaggaagatcatggcatggagtccaaggttctctcacttgcaagtgtcctttgtgcacttcgctgagtgtccttgtcctcatctgtaaaaaggagatggtgatatttagtcttgtgagaaactacttgagagaagtattataagtacctggttacttgatgtagtccttggcaaagggtggattctccaaaattatatcttcctatttctttcattcaacacccactcagccaggataagaccataccagagcaaggagggggactataaataacagcaaaaggacaatatctgcagagaaagtagggagctggaacactgactaaaggaaagttttcatattaccctgtgaattgttggacaaatcattcattgttttttgtttgtctgtttgttttttgagacagagcctcactctgtcatccaggctggagtgtgcagtggcacaacttcggctcactgcaacctctgcctcccaggttcaagtgattctcctgcctcagcctcccaagtagctgggattacaggcatgcgccaccacgctcggctaatttttttttaattttttttttttgagacggagtcttgctctgtcgcccagcctggagtgcagtggtgtgatctcagctcattgcaacctctgcctccctggttgaagcgattttcctgcctcagcctcctgagtaaactgggattacaggcatgttccaccacacccagctaatttttgtatttttagtggagacggggtttcaccatgttggccaggctggtcttgaactcctgacctcaaatgatccacccacctcagctgcccaaagtgctgggattataggcgtgagccactgcgcctggcctggctcattgtttttatatataaaacttacatattttctttcctatgggagtgttgtgattactaaatgagagaatgaatgcgtagtcattcttcaagggattgtcacacagggaagcttcaatatgtttgggtaacagtaatattatatgatccattttcatttctatcaatttggtcagctaaactgtactttaattctgagattctttaactccgacagctggtccagactggcataggtcctgggggcaatgacagagtccagatgtccccatgggcatgacttgcaaattatgtactttgacagaatatggtgaggacaagaaccagaccatgcagcactattttcacgccagctgcagagtctaaatgtgtttcctgacacctcagaaccttcttgggggagggcattctgggctgggtgatgggacatgctgggattttgttgctctccttcccttgtgggtcttaatggaaaagctaagtcaccagcaacagagaaatagcggtgtcaggcattgttgaaactttccatgtattctcatgacacatcatttccagttataaaaaagagtggaggtgttgggctctgttgcctaatcgtggtaagaagtcccttttactagaatgcattttttcatcacagcatcatggtcaatgatcaaccatgtgaacttgtgtaagttgcataaacttttcagtatcttgacgtctctgtgggaaaagatggaggccatatgtgggagaacaaaatcatgattagagacatgggagagaatagggcttcagagtgcagctccacttcagaccagtgcatggcatagtacacattgcctgaactctctgagactcagttttctctcctgctaaatggaagtgatagttggtccattttatggagccgatgtaaggactaaaagttataatgcatataatgtcctttgtctggcacacattaaaggatcaacccacttctgctaccattattattaggaacaaatacttactaagaacctaccatattcaatatcacctgagtgcattttcatattcaattctcacaatgacacaaggagatattatcctaatgttgactgtgaaaaaaattagacctggagggttcaagtcacttgcccagattcacatgggtgtgagtggcagagttggaacttaaaccaagaatttttgataccaaaacctattgatgatctttccactgaaagatactgactagatgtcaccttgctttccctgtcaaatgctaatcagagatcaatgactaatcaaatggaactaattaattctgagtcaacaaatatttatagagcccctggtatttgccgagtgccatggagatgagagctaccatggacaaaaggatggtcacccaatcctcggtggtacaggacttctgtaaatgccccaggaggtcttccctttttcccaggttgatgccttctgaatcacttctgtccattcactgctttgtcagcagcagtttacttgactgttaccttgggtaattccttgagcttatttatttactatttttgagatggagtctgactctgttgcccaggctggggtgcaatggtgcaatcttggttcactgcaacctccacctcccgggttcaagcgattcttctgcctcagcctcctgagtatctgggattacaggcatttgccaccatgcccagctaatttttgtatttttagtagagatgaggtttcaccatgttggccaggctggtctcaaattcctgacctcaagtgatccacccacctcagccttccaaagtggtggcattacagatgtgaaccaccatgcctggcctccttgagcttcttgagagcaggcactggatctttcttctttgctactttctctgcaacacactgcctggtacatactaaatgccaaaatcttattgacaggcttgcagcgaggaatgagcatctaccttgctggttagattgcttttatccagagtggtgatccctggggagatgttttgcacttggcctcgtggcagatgggtaacaagtgctggatcccagaggaatgatgcattcaacaagtcctgagttttatctatagtgccatgcagtgagttcctcctgctcctactgccatgggccttgggatgcaccttgagcactgaccccaccttgtcatgcttcctatgtgataagtttccttctgcagccagatagctctttgactcaatattacatcagtattataaactgagtaattgtgttttccttcctccaatcaacatgttgaagtcctccttcccaatgtgatggtattaggaggtggggcctttgaaaggtaattaggattaaatgaggtaatcagggtgaaacccttatgaatagaattagtgtccttataagagtcatgagaaagcttgttttcacttctgccatgtgaggacacagagagaagatgatcctctgtgaaccaggaagagagggccttcatgaaattctagatcttggagtttttgatcttagacttctctgaccccagactataagaaataagtattttttgtttaagccaccagtttatggtatttttgttatagcagcccaaatggactaagacactcagaaaccttcctgtggcctcctggaagacctttactatcctgcaatttctccagggctgtcagaaatttagacttcagtgtggttccagaactagtgtgcagaaatataaggcaaagctcataaccatcctccagtgttcaggctcagcataagccctctaggaaacctttgtacctttctttgggcctcccccaccatagccctcatcatgctatgattaattgctcaattatctttctctctacattgtcggttatttttagctttaattagtttgccagataaatgtatcagctacaagcccttagaggacttagaagtctggaaactttggagaaactgtttataggactggcagtttctgatggagaacataggaagtagaaagaaaatatctgggtagtctttggatattccccagtgagggtctctgagactgatatgattgagcagctttatgaataagacccaagaggaaaggctggagaaaatgagtaaaacaaagggaaattttacgtacgtttttttgcccatgagctagtcatgaaagggagaatcaaatgtgatctcatcaaagatgttcccccttgagatcataactatatatatatatatatatattttttgagacagcctctctgtcacccaggttggagtgcagtggcatgatgtcggctccctgcaacctttgcctcctgggttcaagcgattcttgtgctttagcactgagtagctgggattacaggtatgagccaccacacccagcccataatcatatattcttaagtgggtgtgtgtgcataggtatgtgtgcatgtgttttgcttttcaacctaaaagcgatcatacaatatgtcaacagccttgtgtgttaagcacaacagagttcctctcattcgtaaatgaagagtctgaggcttgagacttggtttgcccaagtccagtagcattaatacaggcagccaggtcttcagatagctgcccaattcccttttcgcatctcaaatatgtgaggtcttcagacaccttggagataatatttgctctcacctctttcctcaaagaattaaatgtgacttgccatcttgagttttgttacaaaagattgtaatgctattcaatagtggtatcatatgttatttaccatggaaaaagatggcaaaaactccccctgaggaactgcactaaaagtaaaagatcaagaccaagggaagagaaaatacaaatattcgaaccctatgtatctaacatgattaatatatccgagatacatatgcggctctggttaccagaagccaaagaagaaaagggaagaagattcatttatttgtccttaggaaaatagcagttccccagtcaaagaaatattttgcaagcacttagatctcagagaggtcatttaaaaggcctttagcatttattcaacaaatacttatttactagctactatgtaccaggcaccatgctaagatatgaatatacataatgaagaaacaatgtccttgtttctgtgaagccaagtctagtgagggagaaagatgttaaaattatactcttctatatattatgatatggtcagtgatatcttttggctctgcgtccccacccaaatcccaccttgaattgaaataatccccacatgtcaagggcaaggccagctggaagcaattggatcttggggcagtttcccttatgctgttcttgtgataatgagtgagtgtcacaagatctgatggtttcataagtgtctggcatttcccctgcttgcactcattttctttcctgctggcctgtgaagcagtgccttccaccataattgtaagtttcctgagacctccccagacatgtggaactgtgagtcaattaaacctcttttctttataaattacccagtctccagtatttcttcatagcactgtgagaacagactaatacagtcagtaatggaaaagagtaagatgatgggagagaatttgaaaggatttggtttagctagaagatagctcttgttaaagtgatactatagctgagattgaaagctaactaggttttaaaaatttggagcattaagaagaatagtgttcagcaagaacagcagatgtgaaggtcccaagtcaagtacaagactgatgtattccagaaacttttaaggacagtgtgttagtgtgaatttcagaggccaaggaggagaatagtctgggatgagccctgagagtagcaggagcccagtccccttccctgcagagctttgctaatgttggtgagatgtggtctggagagagacattaaaactactgaaggatttcaagagagaaagtggctgtcagatttgcatttaagactattgctctggctattggaaatgatagcaagaaaagtgggtgaaaacaagagtgcaagtctggaaactagaaggaggttatggaagaggcacctttgccagagattagggtgatctggaaatacgatagaaaatagacattctaggacgggcacagtggctcacgcctgtaatcccagcactttgggagaccgaggtgggtggatcacgaggtcaggagatcgagatcatcctggctaacacggtgaaaccccgtctctactaaaaataccaaaattagccgggcgtggtggcgggcgcctgtagtcccagccacttgggaggctgaggcaggagaatggcaggtgaacccaggaggcagagcttgcagtgagccgagatcgcaccactgcattccagcctgggtgcagagcaagactccatctctaaaaaaaaaaaaaaagaaaaaagaaaagaaaatagacattctagagttaaaaactcaacaagcttgatgcaaccatcttgtttcaggggaaggcaattactgcacagagaataatcatggacaatgcccctcaaacctccacatccccaaaatcaggacatatagaaggttggagcaaaaatataaccttggctaaaataattaatagtgttcttcttgattcaatttgcaggagacattcagagaaaatatccacactcaaaactgaaatatgagtgccacacagtcattgcagctcacatctgggaattttcaccaagcaactgaaaaaaaggctattttcagttctttcatatgctctttttgtcataagttgggttcggggggtggggttcagaaccacagttgctgtggtgagagaagcaaatttgacagcttctggcagagcaaagcacaagtatttcctgcagagtttttcaaagtaaatgggtctccctccctgggcagatactggcaatccttgatgactcacttctgaggggcttagcccatcaaggattcaaagagagggagaggcctggcaccaggcccagtgctggtgacaaagtggcttcttgcctgcttttttgtagttgctccagtgggcacatctgtgcccggaatttgtcatgagacaatgagggtttgttccctgtatccgaaatgatgacttcatgattcttttatggcagagtaagagttggagcagaggagatagaggattaatggagttaaaggagcatattacaaagattgagtttcatattggttaagatctggaatgctttctatctggcaaactgtaaaatccaaagcattaattacattgacaataaggacccaagtgtcctcccatttagctgttttcaaaaggtattatgagtatccaagctgtcagggtgatgtgtgtagactttttttcctttcctgtgtcaaaagcatgatgttgagcagtggcttttaacatttttgacaataacccatagtcagaagtaccttttttttttattgtgactctcaacacacacatgtagtggaaaaagtttaataaaaaataccactgcaataagtaacacacacagtttctatgatattttacttattaaattatttcctgtgtaaaaatgtgcctgtgacccagtagattgttttcatgactctctaacaggttgtgacctgcaattggaagacatagatattgaggaaagaacacaggtcttggctgttgaggctcatgacctacctccccagctgtaggagatttttctgtgctttagtatatgagtaagcatgagagaggtgatgcttcagtaatacacactcccaacatttcagtggcttaaaacaacaaaagtttatttcacactcatgctataatggaggcttgactccatatgatgcagagatccaggctgcaggagccttcacatcaaccctactttctcctcatctgctgcaagagcaattttacttctagctctgactcttttttttttttttgctgtatggagctgggcaagtcatagaaccagggctgactttatgtgcatgtgacttaggcagttgtatagggcctggtgctcagaagggccttgtggcttggcttactactctgctgtcactgccttgaaagtcttaataattttttaacaagaaggctctttttgcaccaggccacacaaattatgtaggtcatttgcatacaatcttttctaagtctccatttcctcatctgtaaaatgggttaatagagaagaactcatagcattcttaagaggactaaaagaaagagcatagtacatacacatgtagttttcaacttgctgcctttatcttcagtagtaccgctacagaaaacttttacttaatcaagttagacttctcaccttgaaaagctgtacttccttatgttgccctccctactcccttctgtttatctaaattttgttcattattcagggctctactctaacacctcctcagggtcctcttccatgactgtccaagctgttttcagaacccctaccccattaattgtggatcccttctttatgactcacttacttttgtttcctcttctcctttggacccttccttggttaggatccctcctacctcgcctggaacattaaacagcctccccattagtaacccttttagtagcccctctccagtttgccctccagttccactctccatcataccagggtcatcttcctgttaccccgaaatgtcttttctatcatgccatttcagttttcagagacttcagtggctcttctcacctaaagggcactgcccttagtcttgcatttaggatctggctctcaggccacattttgggtctcattttcctccactccactcacacactgctcctgcattcctgctctacaccatctctggaatagagcttattctcctgcctttggttctttgtacattctcttccttctactaagatggcctgccaccataggcgtggtggctcatgtctgtaatccaatcactttgggaggctgaggcaggtggatcacctgaggtcaggagttcgagaccagcctggccaatatggcgaaaccctgtctctactaaaaacacaaaaattagctcggtgtggtggctcgcgcctatagttccagctactcaggaggctgaggcaggagaatcacttggacctgggaggtggaggttgccgtgagccgagattatgccactgcactccagcccgggcaacagagggagactccatctcaaatataaataaataaataaaatggcctgccccaagatttaccccacacccctgaaataatccaatctaccttttactgcttggctgaaatcctatctcctcaaagacctcctgtgccagctcaggatgaaaagtctcccttattccttggaatccctatggcatttcttagaatctgacatatatcctgtatgtgtggggcaattcccccaacatcttggttgccttttctgctgggtctgtgttccagggaataaggacaaaaacaaaatatggctagagtttcagtcacacttcgtaggaactccctggaatgaagggttcctgcagagattgcctggggcccttcccgatcccctcagctgttctgaatcatcatcctcctctgggttctccaggaattttgtacattcttctaacatagcactgactactttccatttgagttatttcttgacatgactggatcccccacgaggcatatcttattcattattgcagttctaacagggactggtgtcaacagtgaatggatggattgattgaaggatagagactagagaggaaggaaagttgctggggaggagattccctgtatatgtaagtgtgagacaaggtgggctgtaataacaacctcttactggcacaaagcaacaaatatgtatttctcattcatattcatgtccactgtgagttggccaaaattctactccactgcctttttttttttttttttttggagacagggtttgttcttttttatagcctggagcatagtgacatgatcacagctcactgcagccttgagctcccatactcaaacaatccacctcagcctcccaagtagttgggaccacaggcctgtaccaccatgcctggctacattttaagattgttttgtggagacagggtctctcactatgttgcttaggctggtctagaactcctgggctcaagtgatcctctcgcctcagcctcccaaagtattgggattacaggtgtgagccactgcgcctgtattccctcttcatcctacaaccaagcctgatggagaatccctaatctggggcatgccattcagtggcagaaggaaaggaaagatggcagagacacacaatggctctcagagcatctgtgaagaaatggctcatgtcatttcaactgacatcttgttgaccaaagcaagtcttgtggccacaggaaggataacactctcaaagggatgagcacaggagaaagaggcagtgagtattttgacaaggacacaatcttctacagtgggggcagagcttcatgtggaattccactcacataatgctctttgtctgtctgcatacccacactcgttctgaccagggaagaaggagggggccatctacttggtgattccaggagctggatgtgcagggcgttgcatctgtctctcctcttgctattgagcataagctgcctctagcgggcatgctttctaccttgccctctcagggattgagggatagactctctggatatatggttgtctacaacttggtaggtaggtctgtctaatcctggagctccatttattcatccgcagagccatatcctccaatttgagatctacaagtaacaacggtggttttgattcccgccattgcctttactcctctgccttaattttcaattggtttcaagcttggaaaagaaagagagttcaattttttgatctctctctcatatctccataacagactttgcagaaatatcaggtcaggtcctgttactgatgtgttcattctcatgggcaggaagagacacttcagtgttgctgctgccaggattgtttcacttaaaggaactctctagctgtcagagaaagagtgatactctgaaaatagtctctaacatgctgcttcctgctctaggatcatcttatagaaaagacactatgttcatcctgagccaacctggtccctttatagtcagatactagagaacaatgagaaatggacatgggggatatctttagcgaacatccttagtgaggatctgtctcttcttttcctgttgggcatgagctgcttctagagagcatgctttctacattgccacccaccccaccccaccctgagggatccaggaatagactctccaaatccagggatgtgtacaacttggtaggtaggttgggtagggagagtgttttgcacaagctagagctggggttcatatgtgtctggcaagtggagttaatggtactgttttctatcaagtgtccagttgcataagttgttatacaaagacggtgctttagcttttaactggaggaagagggggacatactgacatgtgggacagagggtagagaaggaagaggtaaaattgagagggaataacgtgattaatttccactcagcctggcccgatgagagactgtgagggtgctatctaaagcttaaggaatcatgtttatgaaaaaactgtaagattttgggaagcagcagcgctctttggagattggcaacaaatatgacaatttactcaaaagatttttatttctggtggttctagactgagtgacagcattggacaaagatgtgtggagcaggatggtagctggaggagtgccagagagagacccgggatctcaccaaggttacagtgtctgtggctttgcgaagattcctcctaaaattctgctcatggaaggatttcaaagaaagactgagtgaacttgttcctgagaatgcttgaagggacggggaaacattaaaaaataaagactgggttattggaaattgatggtggtgttggtgggggttgttaagaactaccgttatttacacactgatgaacttgtgacctcatctatattcacaggctgctggtctctgagctattgagtccacctacttatagggatgttctttatattggggtgaatgttttgcttgtgatatatcactctgtattagtttcctattgctgatttaacaaattagcacaaacttagtgacctcaaacacacacacacatacacacaaactcacacacacatttattatcttacaattctggcagtcagaagtcctaagtcagcctcacgggctaaaattaaggtgtcagcaagctatgttccttttggaggctctagaggagagtttttttgcttgtttgtttgtttgtttgttttacgttttctagattctgtgactgcctgctgtccttggctcatggccttttcctcattatcaaagacgacagtacagtatctttcagcctttctcctaactctgatcctcttgactccatttcataaaagccatttatctcaatatcttcatctcaatatccttaacttaatcacatctgcaaaggtttttttttttttttttttttttttttttttttaacatataaggtaacgtctcccggggagcattattcagcctgctatattctccaaatagttttcattggctttggtttcatcttatcaagaggagatcaattcaacctttactttgtacccattgagtgccttttgtctgctagaaatttttcaggctttatttcaatcaacccccactgtgattctgcgaagtaggtatttatgtgcattctatgaatgaggaaacagggttgcatgcaaattgatctggcttaaaaactcactctttctttacaactttaaatatttcatctccagaactactatattgtcatgattgaaatgactggatgagaaatactcagaaatttcaagtccctgctcccctggtggctacagaagtacagttgagaggcctttcagtatttcttaatagacagccaccttccctctgcctggagtagatgagattcctgactcctgtctttcttctgagactctgcccaggataccctagttttgcggaactgacacacccaaatgtcctgaatgagtcataaactcttcccgaagctaacatgtgatgaggagggaaggctctttctgccacagcctgtgaaatggtttccattacagtgtttctgctgagagcagcaattctgtctttatcctctttcccatgactacagagcctccaacatctgactgagttgacagaagagtgagggggacactggaaaaagtcccaggctggaggccaggggacctggaggccgatattgtcattgcctctgactagtcctatgctcttgagcaagctgctccagtgtctgagtctctggtctcatttggactaaaagtcttggtccttctttgtgcttacaatttaaaggatccctgcatagccaaacggtaccattcttaatggcatgaacaatatcagaaagactttagataacattcatttggagataactttgccatgtgcttcactccctctcaaccggcaatatggcagagtggttaagagtgtagaatctgcattaaaattccagttctgccttttttgactggtttatcttgggcaagccgcttagcccctgtgtcttatattcttcatctatccaatggggataatgataaagatgatgttctcccccgagggttttgatgactgctagttagaccagcactgaccactgttcagtccaatgaaagtacttgtctcatgccctgctattcattcttcctcaatctcccgtagagaaagagacttcagctttaaactcagagtctttataataggccatcagctgtgtgaccttaggcaactcaattcaactctctgatcttcaggatttttcaactttaaaataaggataacaataagagcaacttcatggtgaagggggataaggattaataaaacaacacatgtaatatttctaggagaatgcctggcatatggaaaatgtttgctccctttagatgttatcctcgtcttgtgtgaatcttaaaatttctagcctgcttcagatttaattccattttctttctaagatgtgagaaaacataatttgatatttcaggccaagttaagcttttttattgagctcacacagttgtaaatatgtacattaaagtatgtcctcatgaagaacaaagggcatggatttttccagcaccctccatcccccaactcacagcctcaacatccgcaaataattaatgcatagaggaagtttacggttggccacccaaatgcatctcaaacattaaatttaaaaaactaaaaggatgaacccagaaaactgctataaacttcaaagaatctattaaggacttagacatatggtgttaaaagatatgtccaagatttatggcactgggcctacaaaaaagaattctggataggcttctgctatgtgaaatatcaggaaagggtcagcagaggtgagctctgtgtccccaactgcctggagtgacctcacgagcagaatcagatagcagtggacttagctcagttcttggctcctccagatgcaagccaaacttcaatgcttagggcagcgagaatgtactggacagagagccgctaaagataggagaagatagatcagatatgttttgcatttaggtcctttcttttttttttctacctggaacacaggcagtgataattatggccactaaccatattgagcaattgagcaattgcaatgtgttagatggttttacattgaatttaatttatacctcataacaaactgtaaagaatgtactaccgttttcttcttctagaggggaagaaactgaggctcaacaagtttaagaaagtttctgggagacatatagcacacaaacataaaaccagaatttgaatacacatctatttcatgatggactacttttgtggaactgttaaaggaaacaagtaatggccgaaatgaatggtttagtcattgatctgcttgaaggctgagcagcagatcaaatggcctcttggacacccaagattttgggagtctaagactctgcctttctgaattgcataccttatatgtctacatgagtccttccaaataagctgctcagcacccctggtccatagatcctttgtaattattgcctcctctcaaaagcacaacattgattttatccacctggaagttactgtctgcctgcttttagatagagagcaaatctcctctttgaacaaattcatacaaaactctcactatagtcgggacccaggatatgttttaaaattgattagaagtgttccttgagcttttatttcccttctgtttgtggaggaaggaacagaaatatttccaacttaccttatacaataatgactgttacaggtatgacctcagacccagagtttggggatggaattttctgcctttgatcttggtttgtactgtctctaagatgtgacatctcttctacactgttgccacccagcatccatctgtcatattccaaactgccaatgtgtgtcacccaaaacattagatgacctagttgttctccctgcctagagccttgcctcctctaattcacttcatttaaaaagaaagacatttatcttataaaagaatacaagcatacggaaaagtacctaataatatagtaaataactgtattgcctactgttagcaacttttaaattacatatagatgcatcaataaaggcaatatatagtattgttgtaaacacatttaaacctggtttaaattttatcacattacacaaaccattaagtgagtttctttttaaaaactcaacatcatgttttaagaattagctctgttaatatatgtagatagtttattcatttttaactgctctatggagtacctttgtgtgaatattccacaattgaattaatccactctcttactggtatgcattatttgttgttataaacaacactgcaataagcatccttgtacacatttctttgtgcatatttgcacaagtaactgtggagtacatacctagatatagaatttccagacacataatattgtcatatttatatttactaaagaatatcaaatttactttctcaacagcgttgaatgagtttccattgccctacattcttaccaataattggtattgtcagatatttgacaatcttatgggtttgacaaagggtttcgtttcctaactttgtgtttgttagtgaggaaaattaattcacatttatttattagattttaattcaaatttattagtgagaataattatcttttgtatgcatattggctactgggattttctctctcgtgatttgcctgtttgtgtcattgtgattttttttgtcttgaatttttaatatttaatctgttgatttgtagaaatttttatccctgcatggtatgtgtactaattttgacacaaaacttgcaaataacttcttcaagtctgtggtttattgtttacatctttttggagatatatttatcatttacaagatttttagctttaccatagtcaaatttataaaattttgaatgtttttatggtttgagctttgatgtctgactcaataaatccttgcttctgacagtcaagaagttatttttcatttatttatcatttatttcatctatttatcattttataagttttaaagttttactttttgtattgtgatcctcagtgtatctggaatttattttgatctaaggcagtcttctaattttgttttgtttccatatggaaacccaattgcctttgtaccaattattgaatagtctaacatttctctatttttttatagcagcatctctgataatgccaattttttcattcatgtccctgtgaagagaccaccaaacaggctttgtgtgagcaataaagctgtttatttcacctgggtgcaggtggcctgagtctgaaaagagagtcagtgaagggaaataagggtggggccgttttataggatttgggtagataaaggaaaattacagtcaaaggggggttgttctctggtgggcagagtgggggtcacaaggtgctcagtaggggagcttttgagccaggatgagccaggagaaggaatttcacaagacaatgtcatcagttaaggcaggaacaggccattttcacttcttttgtggtagaatgtcatcagttaaggcaggaaccagccatctggatgtgtacatgaaggtcacaggggatatgatggcttagcttgggctcagaggcctgacattcctgtcttcttatattaataagacaaataaaatgaaatagtggtaaagtgttgagatggtgaaaatttttgggggtggtatggagagataatgggcgatgtttctcagggctgcttcgagcgggattaggggcggcgcgggaacctagagtgggagagattcagctgaaggaagattttgtggtaaggggtgatattgtggggttgttagaagaaacatttgtcctgtagaattattggtgatggcctggatatggttttgtatgaattgaaaaactaaatggaataagagaaggagaaaaacaggtataaaaggtctaagaattgggaggacctaggacatctgattagagagtgcttaaggagattcagcatagtcctgccagcaaagattatttatttacttcaagagtttagagtggcagtttggggatagcactaggagatatcagctgtgatggcttggagaaacagtgtaaactggcagtgtaaacaagagcagggcatgtatgagtagttgagaacagtgaataggaatgactagacagaagatagtagggatgacaagttttttggggcacagtccaagttggtctggtgtctggaatgagactggggcctaataaaaatgagcgtctatacaggagcttaaatgggatgtaccttgtagcattctgaggacaggcctgaattctgagaagggaaagtggtaaaagtattatctagtcctttttaagttggtggctgagcttggtgaggtgtgttttaaaagactattagtccgttctacttttcctgaagactgaggactgtaagggatataaaggtttcactggatattaagagcctgaaaaaatgcttggctgatttgactaacaaaggccagtcttctatcggactgtgtagaagtgggaaggccaaactgaggaattatgtctgacagcagggaagaaatgaccgtggtggccttcttacaccttgtgggaaaggcctctacctatctagtgaaagtgtgtacctagaccaagaggtattttagtttcctgactcagggcatgttgagtaaagtcaatttgctagtcctgggcaggggcaaacccttgagtttgatgtgtagggaagggagggggcctgaataatccttgagaagtagtagaatagcagatggagcactgagaagttatttctttgaggatagatttccacgatggaaaggaaatcagaggttctaagaggcgggctagtggcttgtactatagcatagcctgcctttgctggtgtgtggtgattaggcctggtggaactgccatcaataaactaagtgtgatcagggtgaggcacaggaaagaaggaaatatggggaaatggggtgaatgtcaggtggatcagagggatacagtcatgggggtcaggtgtggtatcaggtataatgtgggaggccagattgaagtccgggccaggaacaatgataattgtgggacttaacaaagagtgagtacagctgaaggatccggggagcagaaagtatatgcatcagctatgaggaagaaaatagattttggaagttatgagaaatgtagagagtgagttgagcatagtttgtgattttgagggcctctaaaagtattagggcagcagcagccgctgcacggagacatgatggctaggctaaaacagtaaggtcaagttgtttggacagaaaggctacagggtgcggtcctggctcttgtgtaagaattctgaccgcactaaccatgcctaggaaggaaaggagttgttgttttataagggattgaggtttgggagattaattggcacaatcagcagggagagcacgtgtgtttttatgagaattatgccgagataggtaacagatgaggatgaaatttgggcttgactgaagtaatgggggctgtctgtgaagccttgtggcagtacagcccaggtaatttgctgagcctaatgggtgtcagggtcagcctaagtgaaagcaaagagaggctgggatgaagggtgcaaaggaatagtaaagaaagcatgtttgagatctagaacagaataatgggttgtagagggaggtattgaggataagagagtatatgggtttggcaccatggggtggataggcaaaacaatttggttgataaggcacagattctgaactaacctgtaagccttgtctggttttaggacaggtaaaatgggggaatggcaagaagagtttataggctttaaaaggccatgctgtaacaggtaagtgataacaggctttaatcttttcaaagcatgctgtgggatgggatattgggattgagcggggtaagagtgattaggttttaatgggatggtaaggggtgcatgatcggtcactaaggagggagtagaggtgtcttatacttgtgggttaaggtggggagatataaggggaggatgtgaaggaggctttgaactgggagaaaaggcagcaatgaggtgtggctgtagcctaggaatagtcagggaagcagataatttagttaaagtgtctcggcctaataagggaactgggcaggtggggataactaaaaaggagtgcttaaaagagtattgtctaagttggcactagatttggggagttttaagaggtttagaagcctggctgtcaatacgcacaacagttatggaagcaagggaaacaggcctttgaaaataaggtaatgtggagtgagtagcttccgtattgattaagaaggggacggacttaccttctactgtgagagttacttagagcatctgtgatggtcctgtaggcttctgaggcgatcaggcagtgtcagtcttcagctgctaagctgagaagatctgggaaggagtcagtcagagagccttgggccacagttccaggggctctggaagtggctgccaggtgagttgaacagtctaattttcagtggggtcctgcacagatgggacatggcttaggaggaatcttgggctgtgggccttccttggcctagtggctagatttccggcacttgtagcaagctcctgggggaggaggttctggaggaacccctggcagctgtggttcaggtatttggagttcttgttgtgctggagatgtggctggggtttgtctcaccgtggaggcaaataattgcaacttagaaatacgttgctacttggctgcctctactctattattgtacaccttgaaggtgaggttaattaagtcctgttgtggggtttgagggccagaatttaatttttggagttttatttaatgtcgggagcagattgggtaataaaatgtatattgagaataagacggccttttgaccttttagggtctagggctgtaaagcgtctcagggttgctgccgaataagccatgaactgggctgggtttttcatatttgatgaaacagcctaaatgctcactgatttgggagaggtctgataaagaaaaaggagcattaactttgactatgcctttagctttagccacctttttaagaggaaattgctgggcaggtaggggagggctactcacggaattaaactgtaaactggaccgggtgtgaggagaggaggtgataaaaagattacagggtggaggactggaggctggggaagaattgggacctagcttggcctggcgaggagcagcctggggaggaggggagaggtcagatgggtctgtagaaaaggaagattagaaagactcagcgacgcttggggttgggacagaggggacaggcgggagggaaagaaggaagatttgggatgagttgcactgggcacagagactaggaagggactgatgtgtaaaagaatgcctggacgtcaggcacctcagaccgtttgcctattttaccacaagaattctttagatcttgcaggatggaaaaattgaaagtgccgttttctggctatttggaactactgtgagtttgtattggggtcaagcagcattgcagaagaaaataagacgcttagattttaggtcaggtgagagctgaataggttttaagttcttaagaacacaggctaagggagaaggaggaggaatggagggtggaagtttgcctatagtgaaggaggcaagcctagaaaaaagagagagtagagacacagagggaaggggtttgggagttcttaccttccagaaaagcagaaaaggggtcaaggcacagaaataaggggttggggcacggagataagaggtcggggtgtggaaataagggatgggggcacagagataagaggtcggggtacttgcccctcctttagaaaagcgggacttgccgctaagggtgaaagagaaggggttgaggggttcttgcctctccttcagaaaagcagagaaggggtagagacacggagagaaggggttggggtacttgcccctccccaagaaaagcaggacttgctgctaagggtgaaggaccaaggcaggcatccttgcatggtatgacacctctgaaacatgagtgaataatcagaggtgtccctgcaatgattaaacaccaagggaaggctgccttcccagtctgtgacaggcgctggagttttgggtccacggataaaatgtctcctttgtctctaccagaaaatgaaaggaattgaaattaagagaagggagaggttgaagtgtggcgccaagattgaaaggagaacgaggttgagggatagtgagggaggttgaagaagagagtaaaaataggctgcttactggatttgaaattggtgagatgtttcttgggctggtcggtctgaggacctgaggtcataggtggacctttctcatggagcaaagagcaggaggacaggggattgatctcccaagggaggtaccctgatccgagtcatggcaccaaatttcacttgcatccatggaagagaccaccaaacaggctttgtgtgagcaataaagctgtttatttcacctgggtgcagctgggctgagtccgaaaagagggtcagccaagggagataagggtggggacgttttataggatttgggtaaataaaggaaaattacagtcaaagcggggttgttctctggtggccagagtgggggtcacaagatactcagtaggggagctttccagccaggatgagccaggagaaggaatttcacaagacaatgtcatcagttaaggcaggaacaggccattttcacttcttttgtggtggaatgtcatcatttaaggcaggaaccaaccatctggatgtgtacatgaaagtcacagtggatatgatggcttagcttgggctcagaggcctgacaaattttccatggatttgtttcaaggtgcttgactgtattgtattgatctgtttgtctcttctttatataaataacattgtgttacatacagtgttagaataacgcttgtatgtggtcttgtatgctttattcccttccttcaaagctttatttctttattctttcttatgaagagtataaatactggctggtccattttaatgaaaaccttattataattaactaaaattgcaacaaatatgtagattattttggtggcagaacaggaacctctttaataataagtcttctgttccataaatgtttattcaggctttcttctatgtctttaaagagattcttaaaattttcttctaaaagtttatttatttttttgctagaattattcataggagcctgaagtttttcttgctattgtaaaagtatcttcaatttccattacactttataattggtatggctgaattctagaatgaaaataaatttgcgttgatctaataacttgctgaattctgttatcttttgtaatattttatccgtatttttttaagagtttctaatcatattgtttgcaagtgaatgtcattgtatctctttttatctatttaaaaaatattgtgtttatttttcttattgcattggccagggcttatgtacaattttgaatggtaggagtgatagcgggcatttttggctttttccagattttcaagggaatgtttctaatgttccatcattatagaggccacatagcacactggttaaaaatgcaagatcaaggaggtttgaatttaggctctgtcagttaaaagttgtgtgatttgggccagataacttaacccctctgtgttcgtgtttttccattagtgaaatgaaaataaacaaaagcaacaacaacaataatatttatatcagaagaatgttgtgaggattaaacatatatgtgtgtatatatacacatacatatattaatatatgtatgtatgtatgcatatatatttgtgtacttagaacagtgcctagtacaaatttaatgctcaataagtatttaataatgataaaaagtgatatttactgaatactttttataaagattccttatatgtttgaggaaatttcttcatattcctacttttcctaaagttgtctttatagttgagagttaaattgtatcaaatgcttcttcttcacctaataagataaatgatatgcttttttgttagtgttctaaaatggtggttaattttaacagattttctgccactgaactatatttgcattcttgggctatcattcattgttactgttgatgttattggtacactatatatttgaaattattattttgctttccatttataagtgagattgggcttttttttatttttgtactgcctttttacattttgaacaagaaaaggattgtttgttctttggtgattagtaaaatgtgactgtatgaatttatctgggtattgtttctttttggtatgaaaactgcttatcaattaaaattatctgatatctaattttgtgtaggatttttgtttgtattgatgtcaatattgattgtttctatggtttccataaagtattttatttatgctacattttcaagtttgcatatttggaaaagctatgaaatctacaaattgaaaaatctacaaaaaatagcatgaaagttggtttaatttataatgatttaaaaaattctctactatagccctaattgtggtcccactttgttactatagtttaatttgtgatctctttttttttttgtttttgtttaataatctcttttgcttctttgttttcttgtacattaatatcagttgtttacctgtttctgtcagaggcatttgaaccagaacgactccatcttgagtaggggctggtaaaataaggctgagatctgctgagctgcattcccagtaaattaggcattcaaagtcacaggatgtgttaggaagtctgcacaagatactggtcataaagactttgctggtaaaacagtttgcagtaaagaagccggccaaaattaccaaaaccaagatggtgagagtgacctctggttgttgttatggctcattgtaagctaattgtaatgcactagcatggtagaaggcactctcaggagcagcatgacagttttcaaatgccatggcaatgtcaggaagctaccctataaggtctgaaaagggaaggagccctcagctcctagaattccccagctctttccaggaaaactcatgaataataacccttgttaagcatataatcaagaaataaccataaaaatgggcaaccagtggctgatgccactgctctgcctgtggagtaaccattcttttatttctttactttctcaatacatttgctttcactttatggacttaccttgaattctttcttgagcaagatccaggaaccctctttcggggtctggatcgggatccctttccagtaacatttcccattcttttaatttttattgttttattacctttactttcttgagttgaatgctgaacttattttcaatcttgcttttttttaaaaaaaaaactaataaatgttttttaaggaatacattttctcctgttgacaaaaagcatcaaactccgtaaaatatttgaagagatttattctgaaccaaatatgtgtgaccaatggccagtgatatagccctcaggagatcctgagaacatgtgcccaaaatgatgggctacagcttggttttatacattttagggtgacaggagacatcaattaatacatgtgaggtgtacgctggtttggtccagaaaggtccagacaaccggaagtggaggcttccaagtcctaggcagattcaaagatattctgattggcaattgactgaaagggttattatcaataggaaggaaagtctgtgttgtggtaataaggggttgtggagaccaaggttttatcagacagatgaagcctccaggtagcagccttcagagagaatagattgtaaatgttgcttgtcagacttaaagagtctgctctatcagtaattccaaaagggaggagggtataatgaggcgtgtctggctcccctttcccattatgaattgaaactagtttttcaggctaactttagaatgtccttggcccagaagggtccatttagatggttggggaggtggggtgggccttagaattgtaaaccaaaaataaaattctaaggcccctcccaaccaactaaatggacttcctttttagtcagggttcttaaaatttaacctgaaagactggtttaggccatgaaaggaagtgggggtcagacatgcctcattaatacctctctggcattaacaacaacacagacttcaagtctgataagaaacattttacagcctgttctctctgaagcctgctagctaaaagcttcatctgcatgataaaattttggtctccacaacctcttattgcaacccaaacatttctttctattaatcccaggtcttaagacaaactcaaccaattgtcaactgtcagccagaaaatgtttaaatttacctatagcttggaacctacccccctccccaacagccccctgctttgagttaaccaaaccaaatatttcttaaatgtgcttgattgatgtctcatgactccctaaaatgtataaaaccaagctgcaccccaaccaccttgggcacatgttgtcaggacttcctgaggctgtgtcacaggtgtgcattgcatccttaaccttggcaaaataaactttctaaataaactgggacctgtcttacatgttctgggtctagagatttttatttttggtttacactgggtctacagaattttatttttagtttacacttctaataaactttagaagtttttttggcaactcagaacttttgatatttaggagtttacttttacttttccaaatatatattttaaaatctatatcttttattgttgattttgcatttaactgtttgtagttcagaaggacgttggcataatttcctattgtaacgagtggcaataaaagcaacataaaggaattatgttctctaaatatatcatgtgatgtataataaatagtatattaaaaacccataattaaatccaatttctctggtcttctcatgtcacattagtcacgtttacaaaggcaaaatcttaaagtattagcatttgcttgccctttggtgttcttaaacagcagagcccccaaacaaaagcctatccagtgaagactcttattttgctaaacatccaagcacttcattttctgagtgagagatgatttatccgctccacaacatcagtcatttgaacctcagtgcacagtgtgtgaaccagtggcacttttaaagaataactttgaagaataacacacatgcaaaaaagtgcacagatatgtctatagctcaaagaattttctggaagtaagcacactatgtggcctgcttacaaatgaagaaacagaatataaacagccctctcatgcttcttccagtgataactccaccatcacctggggtaacctctaccttgagttatagcaacacatatgcactcttcctgttattgaactagatgctcttttgtgtctgtcttctttggctcatcattatgtttatggaattcaccaatattattgcattgttatgtagtattgccttgtaagaatataccacaatttatccattctccctttggtggacagtggaccaggtttccagttttgggttattatggataatgctactacaaatattgttgttatatttttggatgaatatgtgtatgcgtttttggggggttgtatacatctataagtggaattgctgggtcatgggatatgcatatgtatgtttaattttagtagatatgtgcaaaaagtattccaaagtggttaaattgatacaatttattgaaagttctggttgttctgtgtctttgtcaacactttgtattttctgtcttcagttttattctgtacttcagtaggtatgcagtgatattgcattggtatttgatattggaagttacctaatgactgatgaggttgagcattctttcctgtgctattgatcatttgtgactcagtgttttgaagaaatttttagtcttttcttcatttttctattgtgggtgtcactgactcaggccagtgtgttggatggtaaaagaatgtaccaagacacttgtggggaaagaaaggcagatttattaaagaaaatacaaagatatattgcaaggtgcaatgggcagcacagcagagaaggggctgtctgcaaagatgtaggcactgcggggaagttttatagggccatagtggaaggggctatgtgtggaacgagataattgggaagaggatgttgtgccaaggagttgtctgtgattagccatctctcagaaaaatgattctcccccaccctgggagccctttttcattgttgctgacttaccaggactccatattttctatgggtttatcatttcttcttgatgtgtataaatcttttacatatttttttgatacatatcttctgtcagatacaagtattgtaaatttttcatcctaaatctcgttttcagtttttaatttttttagtaaacagatgctcttaaacataatatagtctaatttatcatattattattattttatagctgttatttttaatgtcatctttaagatgtttttgcctactgcaggttactgaatatgttgtcttttgtcctacaaattttatcattttgcaggtacaaaatatgtttatcttaatctaactggaattgatacttgtgtatggtgtcttatggggtcaagatctattttttttctctgtattttattttacttttgccatgtggatatttagttgtcacagcaccatttattaataaggcattctttctttttctgcactatcatctcacctaattttaccaccaatctggtaaccactattctacttactattaggttggtgcaagtgtaattacttctaatggcaaaaacatacagtaggcaaaaatatcttaaagataacattaaaagtaacaactacaacaattataacattaaaagtaatgacaaaaactgcaattacatttgcaccaacctaatacctccatgagatcaattttttttagcttccatatgtgagtgagaacatgccatatttgtctttctgtgcctggcttacttattttacttaacataatatcctccagttccatccatgttgctgcaaatggcaggattttattctttttatggctgaataatattccattgcgcatatatatatatatatatatatatatatatatcacattttctttatcccttcattctgtttctgtatgtattttttattttttaatttttgtgggtaaatagtaggtatatatatttatggggtgcttgaaacattttgatataggcatgaaatgtgaaataagcacagcatggagaatgaggtatctgtctcctcaaggatttatcctttgaattacaaacaaaccaattatactctttaagttatttaaaaatatatggttaagttattattgactatagttatcctattgtgttattaaaaaatgtcttatacattcttctattttatttttgcacacattaaccatccccacctcccccactgtacttcttaatgcttctttttattttttttttaaattttgagacagagtttccctcttgtcactcaggctggagtgcaatggtgcgatctcagctcactgcagcttctgcttcctgggttcaagtgattcccctgcctccacctcctgagtggctgggattacaagtgcataccaccacgcccggctaatttttttttttaagtaaagatggggttttgccatgttggccaggctggtcttgaactccagacctcgggcaatccacctccttggcctcccacactgctgggattataggtgtgagccactgcgcctggccaatgtttcatttttaaaattatcttaattactatggctttagaatagattatgtaaatgctctttttcaaacagaaagtatccgtatgtatttcagaataagcggaagcattacatttgaatcacattttctttatgcaagtgagagaattattggaatgcttaggcagtgttataacctgggaacaagaaactagtttaaagtaatcaaattgtcagtgactaagaagtcaaaagtcagtgaaaaacatgcacatgcactaacgtgttagaagtgcccattttgaaaatcaaacgtgtgactgactattcgatcatcaatataagataatactcagttgacgttttaaatattttatctttgcttatggaattttttttactgaatttttaaaaactcagcctcatcgataactttcaataactatgtttgattcattacacttattgtgttttattgatgtatttggaaattctactttgggggctgtgtgtgtgttctccatcttacagattttagagagattgtcaaattttttcatatcccattgttccctaaaatgatttaaaagacctcaattgtagtttcatttgttttaggacacagtcttagattttaacatacatacttatctattatatttgttaataaagtcttaggttagtggatatttctatactctttctgaaaatgacatgcatcttacaaccagttggacttttaagatagtctaggccaggtgtcagttgtgatacagcagtcatatctcaaataatgcccagtttttgagtgcttctttttttttttttttttttttttgagatgaagtcttgttctgttgcccaggctggagtgcagtggcatgatctcggctcactgcaacctctgcctcccgggttcaagccgttcttttgcctcagcttcccaagtagctgggacttcaggcacctgccaccacgactggctaatttttttttttttttgtatttttagtggagacgggggtttcaccatgttggccaggctggtatcgaacacttgaccttgtgatctgccagcctcaacctcccaaagtgctgggattacaggcgtgagccactgcacctggccttgagtgctccttatctccataatcatgtttctgctggttagaattttagaaaagtagtctttttgtcttttcggttgagtgatttatctaccaatttttatcattttatgtgctcattattgtattctacatctcagtcactacttttttattcttcagaatttctgaactctgctatgtgtctaaaatatgttttatgttttgtgtccttcaaagtgcatgtgttggaaacttaatccccaatgcaatcatactgggaggtggggctgatggcaggtgtttaggtcgtgaaggcaccactctcatgaatggattaatgctgattgctaaagagcttgaggctacaagttcgatctcttgttctgtcttgcccttccacctttatcgtggaataatacagcaagaaggctcttgctaggtgctgacttttcaatcttggacttccaaacttccagaaccatgggccaataagtttatattcgttataaattactcaggctgtgggtgttctgttatagcagcacaaaatggacaaagacaatgtctaagtgtgggtttagttttcttttttctgatcactaattaatgttcattttctttttcttttttttttgttttgttcattcagagtcttgctctgttgcccaggctagagtgcagtggaaagctatctcagttcactgcaacctgcgcctcctggattcaagcgattcttgtatctcagactcccaagtatctgggattacaggtgtgtgccaccacacccagctaattttccctatttttagtagagacagagttttgccatgttgctcaggctggtcttgaactcctgagctcaggtgctccacctgcctcggcctcccaaaatactaggattacaggtgtgagccactgtacccagcccaatgttcattttcaatcaggtgaccgccattctactcactactttaatgagatcattttttttagctctcacatgtgagtgagaacatgtgatatttgtctttctgtgcctggattacttatttcacttaacataaagtcctccagttccatccatgttgctgcaaatggcaggattttattctttttatggctaaataatattccattgtgcatatataccacattttctttatccattcatccactgatggacacttaggttattttcatttcttggctattatggatagtgcttcaatgaacatgggagtacagatgtctctttgatatactgattttctttcttttcatatatacccagcagtggaattgttggattatgtggtagttctatttttaagtttttgaggaacctctaaactgtttttttttaccctaatttacatttccaccatcggcgtttgagcattcctatttctctacatccttgccagcatctgttattttctgtctttttgatagtagccattttaactgaggtaagatgatctcattgtggttttgatttgcatttccctgatgattagtgatgttgagcattttttcatatagaggttggccatttgtatgttttcttttgagaaataactacagatcttttgcttatttataattggattataaagggtttgtttttgctattcaattatttgagtttctatattctggctattaatccatcagagagatagtttgcaaatattttctcccattccataggttgtctctttactttgttgattgttttctttgctgtgcagaagctttcacttgctacaatcgcatttgttaattttttcttttcaaacccacagctaatacaatactaaattaaaaagaaaaattgaaggcttttctcataagatctagaacaagaaaaggatgattatttttatcacttttatgcaacatagtactagaagtcccatctggagcaattagataagagaaataaataaaagctatccaatttgaaaaggaaaaaaggcaaattgcccttgtttgcagatgacattatctaatattcagaaaaacttaagactccaccaaagaactgttgtaactcaaaagcaaatttagtaaagttgcaggatagaaaatcaacatacaaaaatcagtagcagtagcatttctatataccaacagcaaacaatctgaaaaaaaaaaaaaaaatcaaggaagcaattttatacctaagtataaaaataaaatacgtaggaaaaaatatagctaaagaagtgaagatttctacaatgaaaactataaaacatttacaaaataaattgaagaggacacaaagaaaatggaaaagtatttcatgtttatgaataagaagaattaatattgttaaaatgttcacacttttaaatgataaacagattcaatgcagcctctatcaaaatatcaatgacagaaatagaaaaaacaatcttaaatctcatttggagccagaagaccctggatagtcaatacaatcctgaatgacaagaacaaagctggaggcatcactgtacctgacttcaaaatatactgcaaaactatagtaatcaaaacagcatggtactggcataaaaacagataccaatggaacaaaatatagagatccctggaataaacccatgcatttacaggcaattcatttttgacaaaggagccacaaacatacactgggggaaaggacaacctcttcaataaagggtgataggaaaactgaatatccatatgcagacgaatgaaactagaattattgaaactctctcaccatataaaaatcaactcaaaaagaatgaaagacttaaatgtaagacctgaaactataaaatgactagaagaaaacactggagaaatactcgggacatttgtctgggcatagaattttttgagtaagacctcaaaagcacaggcaattattttactcattttggttcacaatttcctgttttttatgatctctgaaaattgcagccctacctactaaaaatcttttattagattagaaatttgtttttgtttgtagttgatttattgttgattattagttgattatagttgattattgtttttatcttgatttttatgattgtgatctattttttatgtttattgggttttggttttgctgtttggatgttgggctttcattttcaggatagctctatcacatatttcgtaattttgttttgtagaattatcttatattgaaggaatgttgttttgtgctaatacattttctctttctttagagcatatgtgatgttttcgtccaatggcccctggatctgctatccacagttgtgttttatgtcaactgtttgagattccttctccatggacataatgaggctgttttgataccattactcaagggagcatatagcttggttcagcttgacttttgactgcaaggctgggtttgcatatactgccttttttgtcaggtggctgtagccctagacagcctcttattaacgggggatttccagtctcgcttattaacaggggatctcaatctccctcttaatcctcagcagggagcctgactgcagtctacagcttcagcttcatgttggctgaactttttctctgttcttcccatagaagtagaaaacctggatgcctcttcctgtgtggactaggagcccagaagcctgtagcttcagcccattttaccttttacttattctatttctcatccacagagatgttgcatatttgaagccagctatgcatttgaatgttctctttggaactgttatccgttatcattgtgagtttggagcaatgccacttgcctggatttcttcctttgtttcctacctggcaaacctaatggtattccctaaactccaaatatctgcacatcatttccctgtttataacatttcattctatcccaattgaacttcgaacaagtgtaaatgcattaccagacctttgaagacctttaatcacagggcctttgctcctatttatatgaagctgctttcagtttcccgaatgcattgcacttccttcaaccacaaggccttcacatgggctctttctccatctgataaactctcacttctctgtcttgtttgtacttagtcttcctgatctttctcatctccatttaatgtcacttccttcccttttcttcactccacggactttccttcctccactcccacttcccatgtgataacacttgtcccatttccttgtaaccactttttaatcactctttcctcatagactgaagctttttgtgaatagagaacatgtcttgctcattcaattcttaatcactgcacctagcatatcatagacacccagtaaatattacagaataaataaattaatgaagaggcaatttactccttcatcttagttcttccttgctgtccagacatagtcctgacttgcatgtgacatgggggaacaaactgttctatctgtaccaccagttaactaaggagtccttcaggctcagctatgaattccatcaggaaaattctgagctttttggagtaatggagggagaggtgatgggattctgttgtggaactgagagggtccagtggaagtgagtcagaatgttcagtgttctgcaacaaagacttcccttcactaccccttcaagcatcacacagactctccaggtctggggtggcttgtggtcccatgtggttattacatgcacctctacgtactgaatttgttgatccttgcagactagcagtgcaagagctgatctgaactcaggggccctggagaagcaaagtcactcctccccattctgaagcagctgtggttccttacatttggacacaggcctgagaccttggctacagtgagctagtgctggggaatctacttattgatcaccggagcagctgctaagcctggctttcaagaacatccctcagagggtgctttcactgtgccaaaatctttcattcattttcctctaccattttaacatgcaatttagttaaaacactttcctttcatgtgtgtgccaagatggtgacttcataaaggtcaggaaatgaggaagcaagaacttccttgaaagatttaaaataaattatttttagtaataataaatgacaaattgggagatttaagacaaagattcctggtagttgaatgcgctgaaatctatgatgtttggggattgttaacaatcttcttccaggatttgatcggttttgtacttgtattttctcaatctactattctttacttgctctccttcctttagaatggacaaatttttgtaaacttttaagttttctctttccttgaggtagtaaattggagttgagctacacaggttcctctttcctgatatcccctttctgctatttgatgtgagatggctcttgaggctaaaagtgcagtgagggaaagagagtcacattagcagagctatccagaatatcctctggttattttggagcctatttgtaaaataagcagggaagtgtttggggaagagtgttggcttaggtaggaaagaaaccctccttggtctttgccctgctgtttaccagccacgcggccttgggtaagtcattcaagaaatgtaagcctactaactgtcaaagcctcagttccttttacttgtaaatgagagagttgaattaagtcaaagtagtcagttcaacggcttgcaaagaataagggaatttaagaaagcagagaagtttcagggaccatggagaacaaatcgtgtgtagctaatatgtaactccagaggatggttactgtacaaaaaaagcagatcaggcattgtcagcacatctgattatttcaagggaaccccagatctggatttttatgtgaaatattctaatttcacatataattagcaactcattaagaaaaaaactaaaaatgtcctgcttagggcaaaggagacatatctgtgggctcatcactgcctgtggacaatctgtttgcaaccttgggaatagatgacctctgacaccagattaatcatctgccttcaaaattgactaacttcactggacccagtcccaggtggagagtctgaaagcctagaaattgctgcagcagcatcaacttcctgttggaagctggggaggcaaagtcttaccctgagaaagggctggatttctcttaaaattttgaaaggccaaaggtggtgtcagcatttttgtgatatggcaggaataatactgtgcagtggatagggagctctgaattcttaccttgggtgtgctaaaaacctagcctggacttggttacatcccctcctttctccggtgttctcttggtgggtttataattttagattaaatcagtatttctcaaacttcaatgattggtgtattacagtgtggtagccagtctctgagatgattcttattccttgtttttgcttccttgtgaagttccctcccatatggaataggagtgatttatgcaactaattagagattgcagaagtgagtgtgtgacttctcaggatgtgtcataacagatattgccattttcaccttgatctctcagatcacttgctctggaagtacactagctgctatgtcatgaggacacttaagcaacactgtggagaggtccacatggtaaggaacagccagcaccaactcacaggtgaatgaaccaccttggaagcagatcctccagccccagtcaagccttcagatgactgctgttgcagctcacattttgactgcaacctcatgagggactttgagccagaatcatccccaattcctaacctacaaaaactgagagataaaaacatttatcactgcttaggcaaccaagttttgcattattttattatgcagcaatagataactaatacaaaatcatgattattgctatattggcctaccattgataatgttacacattaatgcatgtcaatgcatttaaatggtttattctttcaatttaaatagatttattttaagaggaaaagttttatgttgtaaataaaaaataagcatcactagccacaaaataaaaataactcagaatttaatttccttttcctgtgactcattttttatttttatgttttaaaataaattttattgcatgtatttaaggtatacaacatggtgttatggaatacatatagatagcaaaaaggttactacagtaaggtaaattaacacatccatcatcttacacagttatcttttttttgtttttgtttttgtgtcaagagcagctaaaatctactcatttagcatgaattcccaatatagtacaattttattacctataggcccacgttgtacgttaaatctctaaagttatttatcctacatatttgttactttctctcctttgacctacattttcctacttcttccttttctatctcctcctttgccccagtaaccactgttttgttctctaactctgtatatttgattgtttttaaaagattccacatataaatgagatcatgcaataattttctttatttttctgtctatgtctggcttatttcactaagcttaatgtcctccagacacattcatgttgtggtaaatggtaagatcttgttctttattgggctgaataatattcccttgtatacatataccacatttttgtatccattcattcatcaatggacacttaggttgtttccatatcttggctattgtgaataatgctgcaatgaacatggaagtgcggatatctttatgaggtgttgatttcatttcctttgggtatatgcccaggagaaagattgcattgctgggtcatatggtagttctatttttaatccctttagaaatatccatactgtttttcataatggctatcccaatcttctccaatctaaattccatttagataatgttgcctgcagaagactctgagcctaaggcatctcatgtctttggaacaaaactgggactttatccttgaattaaacaaagtgactgatacgcaattgagcagggaataactttctcacagtgaaatttgatgttaaaatgccccctctctctacacccccaaactgtcttacagtcttccaaaaaatgttggtgttttcttttcccccttttgggaaaattagctaaagtttatgtgtttcttcacattccaaaacattctaagatagcacataatctctgtgtcaagtaagattgcctataataaagtcctgtaaaatagctcaccccagtttttttgaagtattgctactaatataacgccttgtggttatttaaagatgcacagtttccaaaaccctgctctgttcactgggctttagtagcaacaaagagactaggtctgcctgaggattatcatccttaaatgtatagattaggaagttgaagcctggagaagtgaaattagataagataataagataattcatctagtaattagtagggctggggttagaacctgggtcctctgggtcctccatcactctgtgtggcctgcacagaatccagtccatggactcttcacatgtgaggactctagctgcacatgtggggactcccaagcaggtatagtatatcagagcttgaaggaaggctggcatggcagggtctggggtggtttgggggcctgatgcacggttatcagaggagaatctttaaggaatctgagaagctgagaagatagcaatgtcaagctcgccaagcagctgccatggcaaatgagattacagaagcagtcttccctgcatcccagaggctgccacagctgagagtttaaatttgcagcttcagaaaggaaagcagacacacaaatgtgcacacgaacacacacacacacacacacacacacacactcactctctctctctctctaatgcccatgtgatatcaaatgtagccttgacaatgctccagcccccacagagatgctagtctctcccacttctcagtcaactccctgaaccccatctccctacatggctgtaggatgtttttgaatttctactaaaaaatatttctgaatctttgtgcatcttgaatttgtccaggactaaagaaagaaaagtatattttgatgtacaggaatgcatggagctttgtggttctctactcaagtggagtagtatttttatgtatattgggtgacaaaacattcagattacatggaaaccaaacatgtcaaagcattttggagaaataatttggtagctatttccagatgcaaaaatacttctgtttctcagtcaagttctttgtcctatttaaacacaggccactagagctagtaattgtcttttcttaggatattttaaaggtcctggaacacaagactggaaccctggaaggatcagattgtctcattttaccagaagagagactgaggcacaagaggagaccaagcatggctccagggacgctagtgagtcacctgcagatgagattattcaactgtataaatgaaatcatgtttcacctgcaacgaaagaaagcacaaatcaccagtttttacttctttctcttcttttactagttttaaatggctaaatggatcacctcccttccattcccccactccatctcccttaaatttggaaaccaattacattccagggaggtagagatctggtgataaaggactcgtttcaggtttcacacttgaatacatttttacagcttgcttataaaattctgaaagctggtctcctagtagaagggaagatgctgtcaaatgctaaatggtgcagttagagggacattcagacctcctctctagcccttcctctttttctggcacccaaaggcacgggcctttcctgtcagctgtgcaggctcctcattactttctaggatcagcacatggatcggctctacggggtgtcagactcagtgagtcagcaaagcaaagcagctgggctgagacagtgagacagtggacagtcacccagaacagaggcagggctcatacaccagcagccggggaggagaagctgtgcagaatccacatcagagacatagacccaggggcatcattctaatagagggcttccacttttgatattcttctttgttgtctggtatgatgcttaataagtggaaggtttaaagggaaggtgtgggggtgagtctatttattccttgtaatatttttccgccaatttgaaatagacgaattagttcagactatgacattttggctgatgcaaccttattttattacttattttattatagatcagagtaaagggttaagtcatttaattcaggtcaaattctaaaagaaggatattactcaactcataaactatatagtctgcatcaagagaaatggcttttatcaacagcaatcaaactcccttatccaaaatagtaaaatcttgagacttccaattttaatgtaatattttccattttaaatatggataattatttgtgctaagtagctaaatataaccagagacattaatggacaaatgataacaacacaaataatatatttataacagttagcatttttaagtacatcatttaccatattatagccacactgcagagaaatttatttttaatggatgctacctttgtagctcccctaattctgaaaagattttgtttaatctttttagcaactctaattaattattatcatcttcatatacatttgttaattcaacagatattcaacagatatagctattatagtataagaaattaaaacaaagtgatgcgaaagaccaatctcaggggagtggagatctttggtcaggatatgaagggaagggctctctttctagatgatgggtttccaggtacaaagagatgtgaagatgtgaagattgttccagggcaagctccgaggtgggcaaagtgactggtgatggtggggagagggacaggagggaggttgatgaggttagcaggggctaggttatgtaaagccatgtgggttgctgtggggaattgagatgagaaaacagagacattgaaaggcattaagtctcgtttccaaggccacactgctaaccgggagtggtggcaggtgtctgtaatcccagttacttgggaggctgaggcaggagaattgcttgaacccaggaggtagaggttgcagtgagccgagatcgcgccactacactccagcctgggtgacaagagcagaactctatctcaaaacaaaacaaaacaaacagaaaagaactgaagcacagctaagccggataagaatttatctctatctctaagtgtatctctctgtcttatgtgtatttcctgtatctcagtttctacatctgtgtattatctatctatctatctatctatctatctatctatctatctatctatcatctgtctatctttctatctctctattatctatcagctactatgtgccaggaattgtaggctgaggagatgtgacaataaacacaattgccagagttcctactctcatggatttttaataagtgcaataaagcaaactaaaatagggaaaagggatgtaaagcaaactaaaatagggaaaagggatgtagagtaaaagggtgcttttgtggataagatgctttaaacagagaatatctttgagtggaggcaggaatcaagtgtggaggcagacatgcgctctgtgtctgcagctaagatagctttgtaattagcattttctaaatacaggaaaacatgattgtctttattgggtagcgtgaaacatgccatgactatcttgaggtgtgtgtgtggggtgtgtgtgtgtgtgttgatcaaatcctttcccagaccagaaagagcaagaaaaggtcagcctaagttgtataaacaaagaggatttggaggcttcaggttaataaagttttgtggggtttagagagccatggaggcggtgttcataaaaatagagaacccaaccagacagaagtttgtgtgtgtttgagacatgagtctttggtgtctacacaccaaaaatcagttatacctggagaaataattatgacattttcaacagaaaagtatttaggcatggttaagatctgacccccacaaaagattgaggaaaaattgatgagttcagcaacagccaataaaaagtcatgggaagactgaatgttggagtttagttacctttgggtctgagaaactgcattatattcccataaaagactgaagattaagccatattcctctctctgtgcattatattccttcttttttcttttttccctaacagaattttagttgcttgaaaagaattaacatagagcagaattttgaatatggctaggattagctattgtagcataaggtaagtggaaaagaaccccttgtcatgttgagtttttggaatgtctagacatgaataaaaattaaaaggtatcattgattgtttctgttttaatgagtataaagtgaattgggcaattcacaggctaactccaaccattttgggcttcctgatgactagggccaagatatttcaaagagtactaggtgatttattgggtcttatgcaattattattccaagaagagagatgtcgtgtccttggcttatgggtctggaacctactcatgcatctgtctatccaggcttctgtccatgcatccaagaggcttttatggagctctgtgaatgtcacaaagatgaatcaggcatgccctctgttcccaaaaagctcacagcacagccacagatgaggaaatagagaattatgttttttaaagtagggtaagtgtaggatggtggcaagggttagatgttttgggattgggggtaatgatcccaaattggattagagcacctggtaacagtttctcagaaacgctgatgattatgttcatcctagagaagaatgtgtggaggttgtgcaggcacagaaggaagaaagaggttttccaggaagagggaattgtacaagcctgggcagaggcacaaaggggtggaagagcaagattcactcagggaattgcagtaaattggcacgactggagtccagactacatgtttggtcaggcagtggggtaggtatagaaaaggaaagaatggccaagagtgagagactcagagtatttgggatagagttatgagaggcctgggggacactataatgaacttggatttgatgctagtagctctgaggaaccatgtatgtaatttaaattgaaggtgtctcactaagatgatggaagttccattgggctcctatggggtgagtagaattctatggcaattttttgcaataattatggcacaagagtgaggccaagagtaaatgatctggagtgtgagaagccacttaattctttgtatgttggtccttaaggtgtaagcatccctttcatggaccttttgtaggtccaatgaatgacctcaacatgaaaccttgcagataattttgaaagaaaaggaaaaaaaactcttcaatcatgaaaaggtctccattatatttccaagctatgtgaaaatttttattatatatcaattactttggaaacatggccattgcatgacactgtttctcattcatgaagggaacacttctgttttgaatccccagcggtgcctggtgtagtgcctgagacagagaagaagcttagtaaatgttcaaggtattggtttgctaatgatccaaaccaagctgtgtttgggcccatttgaacatttaccgaaccatgttgttaaatataaggaatgtcagtaataaccacaaaagtaagtcagtaaagacaatagagcaatgtcttagtagttatcatctactgaagatctgctcttagctaggcatggtcgcaggctctttatgcctcatttcactaaatccttaccatccccacactgtgtctgttttattatccccctttacagttgggaacactgaggttaactgtgtttactcaacaatctcagggtcacacagatgcagagtagaaaagcaggatgtgatcctaggactaaaggcagacaaagtctatgccttttctctcctattgcagtttccacatatcagcaggtacttcctgtgaaagaggaagcacatttgttctcctggctccagagaagagaaagcagactggcagctctcccatgagggaaagaggagaactttgacaggaatttacgaccaccagggagaacagaactaacttttctgtaaggctgtggccacctacccctgaagatgagatgctgatgtagaaaatggacagccatctcttagaggatctgcaaaataatttctattctggttagaaaaattaaatacattcactttatctttatgatcttgagatattccttggatagtaacaacagctcctgacatctggagactatttcattttagacaaaacatttgcatggagaatctaatatgatcccatgtgacattctttttgggacaaggtagctgttgctcagagaagcagcaggaattgtccaaggacacacagggtgaatgaaagacttggcagtgggacctgggtccaataatttcaagaccagtgctccttcacctatgcatgttgtctactggagtgaagcaaaaatatgggtctatagggcagtattatgcagaatgagtagtttctttccattattagcataagccatactctgaagctatttctgagacagtcatccttttctatgtgggtcaatgttcctgcagcatggacttccttctgggaacaaagcatcctttaggatcttccttaatcatcctcatcagtgtaatatgttgcttcctgtccaactgtgccccatttccataggcaatttatctgtatccatagagacaccagagatctgcttcttacttcaaatgtttcatatctaggttattcttcctgacatgtgagtccagggcacaagtctaaagctcccacttacacagcccagagggactgagccctgctttccacagtcaggtcaggagcacactgactcctgactgtggaaaatttgtctgtgtgctaagtgtaaacagatgtccccagctgccggatcctttggccatatgaaaccaatcaccaactctacacaaacatgcatcatcaggctaaaatctgaaggtgcaatgaactcaccctgcttcccataggacagtgggtgagtagaggctgtggggagtttggtcagagcagtccatctaagggcaaaatttgtgtggtttaatgagatgaaagtggtgaagcggggccaaaggaagtgcagctcagagttaggatagatactggttcaatatcatctggacactttcaaccctgtacacatgggggcactaaggtttgggggtagaagtgacttcctcatgatctcatagcactctagtgattccctcagggtttaatcacagatcagaatgcccaggccagtactcattccattatgtaaggctgcctatgacactggctttcccttgagcttcttcatgtggagtccttgcatctcttatgttttaaatcctggcagttttggattgacttttctaagccatgtgaactttcctaaaggataaaaatgatgatgccattgattgtgggttaatattaggttagcctagatgttctatgtacttaattgcattaatagccctaacgtaccatgaagtaggtcttctattttaaagaagaagaagctgatactcagaaatggaaagagggttgcctaaggacacagcttttagatggcacagcctgaattcacatcaagacaagttccaaagacatagtttaaagaatcaacgaagttatactgaggcatctgattgacaatataagatggctgcatgattaatattatttattcacttaaaagaatttattgagcatttattatgtgtctggcagtatatgtggtttcaaagttgagcatgacattattctattaagaaaacagtgtagtggtggagttggaaatacaaacaaacccctcatttatgttgaagcaattgttaaatggatgattgatcaggtataattggaatagagtaaaaggagtgcatcagtttgtctaaagggtaagagatggtttgtcagaagaggtgacacttttctatcaaataggtgaggatggaattcaaagcagaagttgacagtctgtttagagaagtgaaaacagaacaaattatggaattgtggaatacttagggaaatacaggtcattaggtattgttaatttgttaaaatataagcagggaagctaaaaagatgatattaaatatacaggttacaaggaccttataggttttactaagggagttagaattgttctctgagggcaattggaaaccatggattggttttaaacaaaaaacgcatgatggacgtattgtttaggattggatttgattgttagtaatgtgaaactctaaattaatactggcctaaaaacagtaggagtttgtttttcatctaaaagtctggcgttacatagtcgaggattaatatgatggctgtttaggaattcaatattttttcaaccatccccgtatgtgaccttcagactcacattctaaacctataatcagggcaacaaggtggaaacaatggtaaataagaagagagttacacagaggtaccagtgttcttttaaggaaggtcctcagaagcttgcacaagacacttctgcttttatcttatacatcagaacttagttacatgtctacactcagctgcattaaaggttgggaaatacagtctttgctctggatggtcaagagcccatataaaaaatcaggctttgtggttttctgctagaactgaaggatggatattgaggcaagttatcagtaagtattttcatattaaagagatcactttaataactctgtggaagatggacaaagatatagggaagacactgaagatatgagactgaggctggtgataaccatgaggctggggaatgctttccctttcaaatgacctaggctttgcccaattaaggaaattactgtcttagagttacttcttttctattgagtcagaggtagatatatgtctccttcagcaaatgagtcatacccaaggttgggtaaacttgtttagatatgcagagtgaaccacgatatgaacctggtttggactgtatccttcacagacttaaaactctgctcatcattcttgtgtcctcaaatagccagatcagattttttattctgattttctatagagctaagataggtaagaggaagtttctatccatttcattctggttagctgagttaacatgttttgtctgttaaatattcatggaattaggataagaacatgagttttagaaccaagaaaaatgggaatgaaaaactcagctctggtactaatcccaggttgtctggtttgtgagttagtcctgatcatcaccacaccatatggcatcctctggctcttggtttacttttccctcttccttaagctgttcattttcaagtaacatggggaaagtcacaccagtcttactgagtatccctaaaaaatggaggcagaagaatggacttgatgatagaaaaatttattcttgggcactaagcgtgctcagctggctatgtctacctccatacctcccctttaatatttttctcctggcccaacaagtatgtccagggccctataaaggaaataatccagcatatgtctaatgttggctcacccagtcctcatcagctttgagccatctcactttgcttctaatattcctaaagcccctcttcttcagagtccctactcctctattttactcagtttctcttgattctatatcatggcttcattcttctctacagtgtttctaggaatacgaaagagtagggatgttgtctgaaaactccaaggttgagatataacatactgtttaataacagagatgctgaaatcaaactggtatgaatttacatctttcccttactactattaattctggaccttaagtaagttgtgtacctttttcaagtttcctcatctgtaagaaggaggacaataataattcctatcttgtatgttattgtcagaatttaatgagttaacaaatatatgtaatatatatgttttatatatatatacacattttggtttagtgtttggcatatagttaagtacaaaataaatattagctattgatattaattttggggttggaggtcaagaaataaggctggaaagttgggaggctccattgtgaagagtgacttaatgattaagaagctggattttgggcaagaaaaaagaggggctttggacaggagagtgcattcattttctattgctgccgcacaacatgaaacttagtggtctgaaacaacacagactcacagttctggagatcagatgtgtaacatggtaggcagattgcattcctctggttttggggaagccgtacctttctcagcttctagaggttctccatattccctggctggtggccaagcatattccgaattctgcttccgttgccacatcttcgtgtctgcctgactctactgtgtctctctcacaagaacttttgtcccagatagtccaggactatctccccatctcaagatccttaatttaattacattggcaaagtcccttttgccatgtaaagtaacaaatttgcaagttctggggattagaatttgggctttgatggaggacatttcagcctaccacagaaagtaacatggctgtctggggattttccaggatagcttgtgagattagagttaggaaggccagttaagatgctgttgtgagaatgtgagaatgctgttgtgagaatgttgtggggaatgtgaatgtaagcattaggggcaatcaggacactggggaggaatggctgctgaagaactaaaatcaccaagacttggctaatgagattaggagaagggcttctttctagatttctagctgcagggactttcagctaggggatggtggtgtcagcaggagctggcaaataccaggggaggtgaccgacacattgactaaggctttctgagaaatcttgcttcctgtagcctgcagccattcgttataaaacacagagagcagtctggcccagaacagagtttcccacatttcactcattcttaacaactttttccaaacctgtctttttaatgtttcaatttctgaatatttttctttaaatagactccagtaaaagtagcttcatcctaaacaattagtttcacaaaaccacaactctgatatgcctggatatttggatgcacatactattcatacatactcattaaaatggaaatgtatttttccatgcaccagctaaaattatttctcaaaccatcagtgctaagcaaaccacatatatgcaaatgtcggggaaatgacaaaaacacagactgagagattcaaacctagacttgagtgtatcacttgagtccctggacttttatttcctcatatgtgaaataaagataatgtctaacttataataacttagttagataattagtgtatggaaaatgcaaggtgccatatcttataacaggaacccagcctattatatgcatttatattgttgaatcttgtgatgttttttccttatatattaaataagtcagtcttttcataagacctgtcagttaattttgataaacacactagggaattcatcgtctttgcagtctaggtggcaaagcaattttacttactgttttttattacctcatgagtcttctttacttccagggtacttctttacttccagaggaggtatggaggtatggaggtagacatagccagctgagcacacttagtgaccaagaataaattcttctatcgtcaagtccattctcctgcctccactttttagggatactcaataagactgatgtgactttccccatgttacttgaaaatgaacagtttaaggaagagggaaaagtaaaccaagagccagaggatcaagtgaccacgaggggcttagggaaggcattcattcctgttgactgtgctaggagaaccctgggtcaggagatgctggactcctggggtagaaaacctagttcttttcaaagatttaaagtaaagttttgaggtggaaagccctactgttttctggactatattagaatcattcctctcctcatggctgtggatcatattgcttataaaataccagcctcgtgacccatttgagaacatcactgaaggtccacaagataggaacaaatgggttttaaaaaacaccccagggtctctccctactgaatccctacccagtctaacagaattagactcaaagcagcatttgcagaagatagccctctttgcatgagctttccaatgatacatctggttttccttttgaaaaaggccctcaaacctcataaaactgaagtcctttgattcaaaccacaaattccttatagctaacctcagcaaaactccttacacactctgagtacttagtccctgtaacccttattcctcttttctcttccatcttcattaagttagtgggagccaagcttacaaggataaatctgattgttttgttcaattcacttcatattaataaaaattatgggtcatttttctgccttagacctttgctttagaatagctactatttattaaactctaactatggccaagtacattacatagcatcccacttaaacttacaacaggcttacaaagtaggtggtatttttccagtctttccaatgaggaaagagaaacaagcaaacaaacaaaagttattgtttcattgtcttcctgctgctagatgatagatctagtaattcaaatccagtcggtataactccaaagccctcacttctcaagtttgtctctctatataacagattcctaagagttaattttcaaatacgatttgatattttaacaattcctcatttgcctcaggcaattgttatcctgattattgacttcatggtgatgacaattattgctactatgaataacagctcttatcctctaagtgttatactgtgcattttatataccttgaatacaataacttcttgaggcaagtattattatctccttttataaatttgtaaactgagatgcaaaaggtttgttaacatttccatgatcacagagcactgaattaatgggaactgcaaatactaacaaaaaggaaaactttgtacatgccagcacttttgaaatatattttacatggttaactcatttaatccccacaacaaccctgtaaggtagatagcattatcatctgccttgcacaagtgaggaaactgaggcacagagaaataaaatgattattcaaggccacacaagataatcagtgaaagagctagagtgtgaatcagtatggccttgggtctgactcagagcttgttatcacagcaccatgctgcctaactatctgactgcaaagttcctctttgctctgggcaggtacctatgtgagtgaacttgaaactctatcactcattccaattcttttattcactggtgatctcactatgttgaaaggacaggatttgatgcatgccgtgtcagtggtgatcactgttattgagatagatttgcaccgatgtctgggagtttggactgaatgttaataacatacaaaggtgacctgcaataaatacacagctctgtcagaaagctagaggtctgcttggcagagagagtcatcatggattgtggcagattctccttctgtcaaggcttatctgaaggctaaataaatcatgctggaatcttctgggatgttggaagagaggaaaaagtgtgtattggatgggggtagggatgtggaggaggttcagatggaaatggaatattgattagaacaaaggtgaacttgatgtcagccagtgttctttttagaaatgaagggccaggaatggaagttaaaaaagagaaatattttctttaattgcaggcatagaaatagagaaatcaacatctgaagaaattctaagtgacacactgggctctagatagatgttactctatgtttgattctcaatttttttgatctaatgtttctgcaactatgaagatgtagctacactacagcataaagtgaactccttcacaatgaaaatttatttgacacatattaattgataactgacagctataaattcacatttagattgacttcaatataaaatattcacttaaattgctgtgtagtcacatttcttaactttcccaacttttcaagtataaatgatgcctgatgtttggcattagttttgaggattcccaagaacagctatctataccaacgtttaagaagcatcttcatagtgcagatttatagaaagatatcctccagcaatacagaggctatgtgaaaagcagtgtgaaggtgacagatatttgtcacctatgttatgtcaggcactgtgctaagtattatatatgtagcatctcatttaataataacaactgacatgcagagttgttattattaatccccattttatagacaaacatttccaggactctgagttatattgcacaaggctccttgatgttctcatcatgcagcagaatttgaaaaccagtctgtctgatttcaaaacttgtgttcttttaccagaacaccatacactgcctctcagagtaaaggagagataaatcagtgaggacagctaagttgggaggtcaggagactctctctcctggaagagaaacaccgaactaaaacaaaaccatgaagttcagtgttctaatttagaacaccaacctttgaagtcccatattctggcctttgctgggtatagaatacgagccatctcatgctctaagatggctggtaacctttatctctttcttccaggttagaaagttagctgtttctgaaggcattaatcttagtgagaaaatatatcatacattgtaattcattatgccacacagttcgttcattcattcaaaaatgttttctggtagattgactgaaaaaagtagctctggttttatttatttatttatttatttatttattttactcttcccatacccattgcaatgtgacattgcagattttatcaagaggtagtctatttcaccatgattttaatctgggctctccttgtatcttgttttgtccaaaagaaggtggcagaagtgacaatgtgccacttttgattgtagattatgagaggctttacatgcttctgtttctctcccctgctcttgcatccatcatgctatgggaacaaaatcaggccagaatacaggaggtgaagagagacacatgcacacagccacacacagaagcagagctgcctgattgaacacagctaacctcatgttcatgagggaacccagcagaaaccgaaagagccacctagctaagcctgctttaagttgctgacccaccgaattgtgagctaaataaatggttgtggcttcagccactaggttttgggctggtttgttctgcagcaccagataactgatatctattcactaaaatgcacttgggtgccaacattgtggcatgctgtggggacatagaggtgattaagttatgttccctgttctgaaagagccggcactccaaataggaagtcagacatgtaaacaaatgacaacatagcaagttatgggattaatcaaagtaactggtgaactccttttagtaggaatagttctatttcctctgtaaagaaaccactatgatagggagcacagtaccagttggttccaataattcttgtgatagtgtcatccaaacctcagactgcatcagtggtcactcagcaaggagccttgaagattacccaatgctatttatatctattatatgatcctcattaagtaacctcaaaggggaggcaggagcttggaaccagagctttttggaagaatttctttaaagggatagtattctgtgattaaattagaaatagcaagatacttgggagtactgattaaaaattttagtcttttggacttttaatgactgaaaaaattaatagagctctaggctccagaaatcaggaacttgctgagtatctcttttttttatttttcagagaggaaactatagcagctggcagatagattagtgtaaagaagctacacttgggtttgaatcccagctgagccactcagttacttgatcttttgctggtttctgaatctccatacattttgtggtgcttatgtctaaacagggataaagatatttactttataagtttatgatgaggactaaatgtaccaggcacataattaatgttaatactttccccattccttcatttttaattctcctttgctttctgttgccattttctacttttttcaaaagaatctgttggagccccaatacattaaccttcatgaaattgggtcctgaccatccgtgaaatggatgagtttgaacacttccccaatgtcggtctgtaaaagcacattttgaaagtggctttgaaggactgtttgaataataagatctattcatgatcacagagggccgagacaaaaggctgagacaagtctgtttggagaaaactctgtgtggaatgtcaatgcacatattagaacccagcctgtcaatttggtccacagagagaatggtggttttatgacattattggcaccacaatctaacaactctcaaccggctggggcattaaacatgacgaaggacacagatagactaccctagattttttttattcaaagggagcacatgtaatgttctcatgcaaaccagagaggaagtgagaattctttcatcttccttttctttgctattaacctcaatcacataactcttgggttaattttccttctataacgagaacaccaaacagaaaacacatgtgagaattaaataaacacagagtagaatgaaggctgaatctatggaatctatcaggacttgtttacagagaaggtaaattaacaatttcttggaggcacagttttcttacctgtatgataggaagaatcactgttggaataggcattagtgttagggatgcttctagaaagcctctctactagcatactttctagtctcaggacctttgcacatactggctctctatctagagatcccttccttgccgagatgtttttaggttaactcctcaaatttattctggcctttttccaaatgtcatcttctcacagggaacttccttaattatcttatccaaaattgtcatcctattaccgtctacctcctcattctggttgatttttacattggagcatctatctgatattgtatcatatatttacatgctgccttattaattgttcatctcctacaatcaagtgacagtctcacaaggtggggactttatctgctttgttcacttctgtgtccccaacacctataatagtacctgctacataggaaacactcaagcatttgctaaatgaatgaataagtaaataaacatgcaagattgttttggcaccaaaaattacagcatatagtaggcattctataactgttggcagaattaacgagtgtgcatatccatctgtgagcagaattagggaatcaccactctccagcaagccagtgtctctctcacttcacacccctgcagattgcataaggaatgtccagacactttctgtttccagaatgatgtaatgtggaaggagaagacctgcagaacatgttgctcacagacgagacagatgatctcatccccttcctgggcattcccaggctttgctattaaaaaaaaaaaaaaaagaaaagctgcaatgttcaattcacaggtggctgtttagtcctcagccgtttattggcaaaatactttaactcatctcttagctccctggtggctgggaggaggagaggaaagtcatgtcagatatcatctggcctatttcttcagccaaatggaatagatttaccctgagaaactaggacataaagggagagaagtgcactttagcatcagccacaggggacaagctgtgagcaaggggtgatgggggagtttaaaaaacaaagtaagccaagtgtttcattgacaccagagagctgagattgttcttgggattatttcaaaagtctagagcctgaagaaatgatgtacccaatatccctcacgtggctcatttttatttgaaaaatcctttagttttgatgtctgtgtatatattaaactgatcagaatttcaatttataggtatttattactctacggtttataacacatttcaatacacagatcttcacaaaagtcctgaaagtgaggggtatagaatgatccccctttatagttgaggaagctgagtttcagagaggggaggtaaattagccaagattgcacagctagagagcagcggagttgccattggaactcagatctagttatctttaagtgcaaatctccaaccaaatcttcaattcaagacttaaaaggtgacctgcttgtcagctacagtgtttgtatgcctcaaaggtttcccacatctcttttttccgtggttagctactagacaccttatttcagatctggggcagtttgggatggcaagtctgtgcacaaatcaagctgaagtccagttggatgtctcctgaacaattagtagttttgcaccgatttattaataagccaaatagtactgtcgactccaccctccaaactcgcccctcctctcttttctatccccttcccaccaagatgttttatttattttttttcagaagttggtgttagcagctggtcaagtcctaaatacaaaatcatcctttccacaaccatgtttcccatccaatccatgataaaattatccaattttcattgccaaaatgcaccttgactctgtccctttttctccatctttatggccaccaccttagttcaggccaccaatcctgagccttaggttattatatctgcctcacagctgctgactctccttccactcttgcttctctcattcatcatatgcaatgaacacaagagcaggtgtttttgcatacacccatttttttgtgtgcttaacctctcaaggcattttgatgcatttacaaaatcctgaagccttaacgggaccataggctcggcttgatctagcccttggcaaccttgacaaacttatttgtgcccatttcacacttgcttattttattctattccagaagctgctgtgtagagagaaagctgctgctgctgcttttttttttttttttttttttttgagatggagtctcattctgtcaccaaggctgcagtagtgcagtgacacagtcttggctcactgcaatctctgcctcctgggttaaagtgattctcctgcctcagtcttccaagtagctgggattacaggcacgtgccgccatgcccagctaatttttgtatttttagtagagatggggttttgccatgttggccaggctggtcttgagttcccgaccttaggtgatctgcctgccttggcctcccaaaatgctgggattacaggcatgagccaccacaggtagccaagagaggtagcttcttgagagtaaaacacaccaagaagaaagtagagcttggatgctatgagagcgtgaacactggcgatattgtttgaggccctgagtgcatttatgccttaagtgctgcattgagttattgagccaatatatcttttcctctgtgtttttttaaatcaaaatcaagttgatttgagtttattgtcacttgcaacaaaatattactggatttccacaaattcacaatcagttggggaaaagtcgatatgtgaacaggtaaacactgaaaatagatggtttgtatgatacaggtgaacacgagggcctttaaccagtgtgggtgttgaggtgggggaaagtgtccacttccctccaggagacaatatctggtctgaatcttgaaatatacttagcagttgtcatgatgtatctatcaaacagaggatggcagagagacattccagggagaagagaaggcatgagtcaaggcatggcgtgaaatgggatgatagtttctgggaactacaagtcactcatactagctttaatgcagcctggatggtgaaggcaaagggagagatgctacagagaaaggcacaggccatactgtgaagtgtccaatagtttgtcctaacaagataatgttatcctgggaattttgagagagcattgagaaattaatttttccactttaaaaatgaacattctaatccttccccagcctatgtaccataaaagatgatggtgaaggtctcttagtaaaatgtctgtgaaaatgctttgaaccaggtataaattggctaattatactatggaaaacagaaactggaatatgtttgatgtcttctagtttccaggccctggacaaggagagagaatctgatatggtttgactgtgtccccacccaaatctcttcttgaattgtagatcccacaattcccatgtgttatgggagggatctggtgagaagtaattgattcatgggggccggtctttcccatgctgttcctgtgttagtgaataagtcttatgaaatctgatggttttataaaggggagtttacctgcataacttcccttctcttgtctgctgccatgtgagacttgcttttcacctccttccatgattgtgaggcctccccagccacgtggaactgtgagtccattaaaactctttcttttgtaaattgcacagtctcggttatatctttatcagaagcgtgaaacggactaatacggactcaacacagaaaggagaagttgagaggatgtgtaggtgggttttgtgtcccatgagatttcagttcctggcagtgaagacctcaatggtggggcacccttggaagttgggccacatccttatagtgagaggagaaaacactgcttgtgtagttagcctatttcacaactgaccagagtagggcctgctccctacccttctgtgcctccccgttgcatcccaataacatgatcccaaagtagtgtttctgattcttaagttcaaacaacttcagtggtcaggaactttgttcccagaaactgtttccccacgtcccttcttatattacttcctgtatgtgttaacactctccccacccaaccctcggtcattatatagttgaacaaagccaagagtatgccacagtggcaggttcgcacatagtcagccccagcttcagtgtggggacatgattgaattctcggcggctttgaagcctggaaagcagggttgtaattgacaatgcaccaggacaagcatttgttctcatggggggtctcccatccgtgagatcaagaatcctaaagccacatttttggcatcagcctccctggaccattcagtatgaccactaagtgttagattgactctgggctgattgcttctgctatttagtgagttgagatgatgagcctgagctctgagatgttgcaatatgagtctgcccaaataaaaccacttaggattgtcacaggaaacaaaataatgtgcctcttcagtttaagggacaacttggctacatttggaatttaaagagtctctcttccttttctcagtcaagggtacaaagtgtgttaaagtaatatgagatgctttggctaagtattcaattatctcattcatttacttaacagttattgagaacctgttctgtgtcagaaatggtgctaggacttagataagctgaataagacactgccctgccctcccaaaacttgccatccaacagtggtgttgagcagtggtgctcactctcaactagaagatgaaggattccatttcctttccagctctgccacagtgctgggaatacttgactgtaaggggagagctttctgtttacaagcattctatttcagcaaacaggggagtatcttataatcaaggcattataagtcctgcagatttaaacttaatctctcaattgctttatttttaatgccacaaatattattcagaaaaaatatatgaacccattaaaaatcagtgcaaggtctggatatataaagaggccacctggctgggtgcagtggctcaggcctgtaatcccagcactttaggatgccgaggcgagtggatcatgaggtcaggagtttgaggccagcctggccaacatggtgaaaccccatctctactaaagacacaaaaaattagccgggcgtggtggtgggcacctgtaaagaatcatttgaacctgagaggcggaggttgcagtgagccgagattgcgccattgcactctagcctgggcaacagggtaagactctgtctcaaaaaaaaaaaaaaaaaaaaaaaaaagaggccacctgaccaaatgttaagggaggaggcaaaaatatttattaaattttgtaattattcctgatagactgcgttgcagaattcaagaatatatatgtctacaaaatgaattaagcacacacaatgttcagttgttaggcaaattggtatttgtggcttgccgattaacaaagaactagacctcaaacaaatcagatgcatccaaagtactggagctctgcaaagctgttagatgacttataatggctggaatctgatatcagaagtttgtataaaatagattcatgaaaactaagagttggaagaaaatgcaattatattgcattaattgaaaatgcaattaatatttctaattttatgacttttaatatgtggtaatttgataaatatcataagtggacattttattatttcatccacatttctaatgtttaactatataggttaaacaaagagacaaacaacttgttgtcttgtgctcgggcacccgtggtaggtggctgatatagctggttggttttcacaaatgtaattccatctctgaatcttggtgccttcatctaggaaatgaaagtgatgaagtgcctgcttcctctctcattttcaatcatggtgctgttcaaggcagtatgctatggaaaattgtacatctacacattggctttgagtttatttaatagcataaatattattcagagaaaatacatgaaaccattaaaaatcaaccttagggctggatatataaaaaggcatgtttccccattttattcctggctcattgagttggaaagcctccttaaacaaacagacctccagaactcagcaaggcctgcccctgctcccagattctaaatgcaaaaaatgaagaatattttctttctcccatttgttgtatagatttagaatttagaagacatctcagaaggaagaaaatgatgggtggcattctgataacattatctcctcactgatgttttgttcttgctgctgttcatatggaacacagtagtaagtgttgtgtgaggaatgcaattacgtttaaaaaaggaggtgtaagaagctattatagttttgaaacacataaaggtgtctaaactcacttttctctgagttgtgttgatctgccacattagccgtccccatggattggaccatcctatgtggtccatgaaatctcccaagatatttcctgtcaaatggcctctgccactgctatatttatttatcttattctacgagactaaaaacatagttcagctatttaggtgggctctgactagctattacagtctacatataacatgattagatacatctgtggaaaggaacgcatggtgagaaaatgttttattttctctaattaatgtatagtcttcagaacagaactttgggtgttctggatttgtgtttggcccatagctgctgcttttcactggagcaggaaaataatgtttaatagctttgtttaaaggttttcgcttgttccaaacttgttgctgtagagtctatctcaatctgtgtgtatttaagaaaaaaggggaaacaggctggaagcaaaattgtgttctggtctccacccaaaacaccccctattttttttctttttttttttttgcaaaccatgaaagccttttaaaagctgctttgattagcttccacatcactccccgcaacatagagtgagatgctggtttgtggcctaggatgagagaaaggggagccgggactctcacgggacagcttggccacttgagtcttccaaacccaataggctttacttaaatcagagatgcactggaaggagaccaggggccttttgagctctttacccatcactaattctggctccagctgtactccgactcgggtgatgaaagagactgaaagcagcaggactcagcaagcattctggactggatctattcaggctgcgtttactcactttgcattatggggtttccatggcaacaggcacatgtttcagcatgttacatgtaaaggggatgtacctgacagtcttcctggtcaggaaaatcggatcatgtgccgcttcttccctggttgtctaaatgggctctaccatgagtcagtctcccttccttccatatgatacccacagagaaagatgctggaagtcagcgtccaagatcctgaaacaaccatggatcccagtggagacatctgagaatagagtctgctccaaagacagctggcatggttgcaatacatcagaaactgaggctgagtctccttccctgctcttacttggctcctggccttggctgggctttgagggccatgaaatgaaaatattttctggatattggccattgtgattgtgttccaaggactgtgatccatgagggagctggtaccaaagaaaactccatgcgtgagcctgggatattcctcccctgcgatgtctgtctattgctcatatgaccaacctgagagctgagtgtttacagtttataggatcatggagtcatattcaaagtcaatctggtttagtatattagagtatgaaaaaacatccactctctttttcttccatttgcattgaccatagtccataaaataggaccccgcatcatctaagaagttttagaaagaaagtattggttctagctgggtgtggtggctcacgcctgtaatcccagcactttgggaggctgagatgggcagattgcctgagctcaggagttcgagaccagactgggcaacatggtgaaaccctgtctctactaaaatccaaaaaaaatcagccaggcatggtggtgcctgcctgtaataccagctacttgggaggctgaggcagaagaaccgcttgaacccaggaggtggaggttgcagtgagctgagattgtgccattgcattccagcttggaaaacaagagtgaaactccttctcagaaaaaaaaaaaaaaaaaaaaaagagaaagcattggttctttctagacttctcttttactcatccccacaggagaaagttagacttctctgatagtgacaagagtctgattttcatctgtgctcatttctctgagggttggagagagtatgctgaagactgtgtgacatgtgtctctcttgactttgtatgtgtctttgtgcctatctttcatactagactgcacttttcatttctttctttatgtagttcaggaatatcatttatggatagttataataattgagagtttaaaaaccagtagccctgaaaacagatctgatccaatgatgcatttttgtctcactcatagagtgattgtaaggttttgctttgaatattaaactttattgagaaactttataataaaatcctgaattttaaatttatcttggaagatctggcaacatgaggtctgcagtaattagcaggaaatgagtgcaggctgctaccctgggtgaggggctctctggtttgccagactgccttctgtgcccacatcatacatctaccatcctggccactccagtgcacgctggagtatgtgattccaagaacaagaggatgtgtgggtgacactaagcgagataattcctgattctctgttgaaagaggtttgtatgttaagtttgtgtgatgtatgacctgtccttttgggtggtttttgaaggctgtacaggaagccaggttgcccataaggctggctagggtaatgcataagctgcaaaaccagcttccccaagtcaagatgctgaggtctcattataacaccagatgtctaggcactgcagagacggcagacaggagggagagggcagcttcacctgggaagaacagggagaatggtactgagttgggctcttgagtgtgaatgggatttcaccaggcacagacagaggagaggaagctttcagagcagaaggatcaagaggtgaaaaaaaagcaactatgaagcacatgaaactcaaaagactataaatgctttggtatgcctaaaatgtaggatgtgtgatagggacctgggagagatgaggcaggtaacaaaaagtccttttctgtcaatggaaaactactgaaggttattttttaatcacttactaattacatcagtgatgcacaattacactctctttgaaaggtctaaaacattatagataaacttcttcttgacatctacctcctaatccttatcacctctttgtctacctagagtagagtttctcagcctcggtactgttggcatttggggatgggtaattctttgctggaggtctctctcctgtgcattgcaggatgtttagtagcatccctggcctccatcactaaatgccagtagtaccacccacccccatgatccacacacagtttccatagccaagaatgtttgtagatattggcaaatttccgggggggcaaaattttcccaagttgagaaccactgacctagcaggaactagtgttatccatttattgataacatgggacctatgtttacatttacctgtagatatatttactaaggaaagtgctctcttttcttgttcacatagttactgttattctatatgtatctcttaacttgcttattctcaagcccatgtatttgggatatctaaaaatgctagtgcctaggaagctgtcgggttttgttttatttttgaaatgtggcatagtattctgtgtagggatatataaccatgtatttatctacatccatgttgttgaacctttagcttgtttgcttctttcatttttcttttttttgtatttcaaataactttgcaattaatgtcctaatacatatttccttatgttgcatacagaagtttgcatcaggaatatggggtagacttgctgttattcatcttcaaaatgactaaaccattaactagattctttgtgcttctcagagaaatgcttctttcctattgaaaacaaccctaaagggaaaggaaaaaagggggacaaagaagagaagggcagaggagagagtgggagcaaagaaaacaaaaaggggtttaccagccactccactgattcaaactacagtgttgctgagcattggttcagaaaaaaaagttgaatagcgcaacagggtatttcagatgtcaaaggagacatcctggcacaacaggagggagggagaaggatgaagcttccaaatttgtttcccaaagcttctcaagacattgccccccaccctctgatttgacgcaaagccaaaaccagctgccttcaacattctttatcccaaagaaatgtgtccctttaattccctcttaagccatttatgtgagacataatttatgttctgaaaaaaaaaatcatatactttccacggacccctacttcctgggctgatagatcagcacagggcttaactctttgatgggaaattaataaattacatcgcccttgttcacctcactgcattagcaggtgtttgtatctgtcaaccttccccatggtctatccatggggaggagacccagaggttttgggattaatcagctctgatctggaggaagatgaaactgaagcatcctgttatggatgggtccttgacaggcattctgccacccaacctgcaagatctggcttcccctgtgaagtattttaacctccttgctcccctgattcaattccctgatgcttcatctcctatatacttgactgtccctaaggtcaagactgcaatgccttaagggcatgatgatgtctaaagcagccccttgctcctgactgtgctatgttgcattcaatttatctaagtaagtcacaaagtcagcccaaactcaaaagatagaggagccacaaagtcaaataacaaaagagactggatacagggaggaaattatagcagttatttttataaactatctacacgaggcaatttatgaagtttataaattcatatactctgtgaccaacaatttcagttttctttttctgagaaataagtacatatgtgttaagacattcattgcaattttatttacagtatcaaaacaacaaccacctcacaaataaactaaagtttcaataatatagttgtagataaacagaatatatccaaactacagaatactataccatatatatatatttttaaatggcagcttcctatatactagcatgtttagacatcctatgtgaagtaagcaaattacaaattggtacatataactaagtatgtgaaaaaggaaaaaaagaacattttctattgctaaatttacctaccagttaatacacagaaataggtgcatgagcatctgtagaaaatggataatactagttatcactaaatctgtgattctctactgggagtgattctgccatcaaggagcatttggcaatgttcgaagaaatttttggttttgacaccccgggggagggaatggtgtggctggcatctagtgggtggaggccagggatgttgttaaacattttacaatgtgcagagatgctccccacagccaaccattatccagtccaaattgctaatcatgctgatgttgagaatgactgccttatattcataagatgtgctgagctccagacatctggagtatccattgtacatttccagttgaatgctcaataagtaagacaaacttaacctgtataaaacactcctttaatgtctacacccctgaacttgcccctcctccaccctgccatcttacctggccactcacctgcctcacttcccacattgactccgtcaaaggacctgttggctctaccttcaaaccataacctgactgtttcttactcccttcggttactttcctatcacctaagtcaggccacctttgtatcttccctaagccacagaaaggggatagggaggatgaggaaggctggcaccatgtggccaggaaaaccactgtttagagaacgaactgatctcagtaaagtgtagtctctgagggagtgttggtgagaattggaatatggaaatctgcccttttttggtaatagaagaaaatgctaaattagaaggggaaaaaagcttcactcatgaaaacagcccactgattttcagggaggctgtccaagctgggtttgcatgtggtaatcagacattgtgagtgggatttagtcagagggcacagtagccctttgtcagggtggctacatggcccacagtttgccatggcaacaggagactgcccagtgttcttagggaggagaagagtgaaaatggtgcttctgggtgagtagaatggggagcctgtgaggtttggggctggcggttgcaatctcagccatttgtggaattgaagtgaatagctgatcaagttcaataagccctggagtttgaatcagagagaccagtttcaacacatcctaactgtctgaccttattaaacatttgagggtctcagtttatttatctgtaaaatgggtttaacaaccctggctgtcagggctcttattaagaccagtactttcttcccgcggtgacaccatcctgtgcagtctgttaagaaggcttcttgagctcatatgcacttggcaggacttgggatcaggtactgccacagtgggatttagagggcagcagaatttcatgttctcattgtaaaaacaaggtcgctatttactgccttagagacttccttaacatcgccacagcaagtaacctaagggaccagtcccaaaagggtggctaaattagaattacccacctttacataaaagaccaggaaatcaatccctccaatcttacattcccattttaatcaattgctacaataaatagagaacatcagccattcattatcacctagattcatcgctaggtggctctgtgtagctcctaaattgaactattttcattcgttcctcatctccccaattttttcactctgtcctctcaaattcatcatctctcatctatatcctcaaattcttcctttgatgcttctctttatctttcttttccaaagggaaaaatggtagaccagaggctctaaggcatactgcagccctcacaaatggtaggttttccttccacatctctagttccctaaggtaggcattttctttactatttcccaacaattctctcctttctcaaaaattaataactgcattgaaaagcataccatcaggctattcttcccacttttgttttggtcatcagccatctcccaagttgcttctccagatggattgaacagtccagctcctacattactgcctttcttttcaagactacttctgtcattatagtgacctcttaaacatctactcacgtagtttaaccttgaactttgtcattgctggtaattgtgcgttttcaagattttgatttcaagctttctacctctgaccatctccttttgttacacaggaattttgtttgcttaggaacattgtaggataaaaacgcaatgttgctgaagatctcactttaaatataagacaaacatctgaaatgtaccctcatcatcttcaggcatttcctctacatttccccaagtaatccctgctccaattttctagcatgactttgtcacattttatcctctgttttcaaactcccatacccttatcccacctctcaccctcatgggtggcctctacagtgacaaattcaatgatcaattttttttattttcacttattcaacctctaaggaccacttggtcctattaatcatagatttctttttgaaacactttcttaattttgttatagggacagcactccttcctcattctctcctggcatattagtcaggattctctagagggacacaactaacagaatatatgtatatatgaaagggaatttattagaagaattgactcacataatcacaagttaaagtcccatgatagggtgtctgcaagttgaggagaaaggaagccagtggtggatctgtcccaagacctcaaaagtagggaagccaaaggtgcagccttcattctgtggccaaaggcctgagagcccttggcaaaccagtggtgtaagtccaagagtccaaaagctgaagaacttggagtctgatgttcaagggcaggaagcatctagcatgagagaaagatgaaggctggaagatccagcaagtctgctcttccatcttctcctgtctgctttgttctagccacactagcagttaattaggtggtgcccacccagattgagggtggttctgcctctcccagtccactgactcaaatgttaatctcctttggcaacacctcacagacatacccaggaacaatactttgcatccttcaatccaatgaagttgacactcagtattaaccatcacacctggtattccagtatttcctatttccttctaaatctcctttcctggtcttttgtcttctgcttgagcactgagtcatagagtttccaagggtttgatcctcctctcccattgttttccattccttttcctctttgctttcttctcttctctctggtttcttaggtattcccaaccagtcccctgacttgaaatattacctatatgttgctgagccccagatttattctctagcatgggtgtcttctctgagcaccacacctgtatctatatctccttttcatcccacttggatgtctataagaggttgatctacacacaacagacctccagatttctaccaccccaaacttacttcttctccagttttccccttaataggacatgttcaactgataatctggttgctcactttcttcactttgcatatccactccatggataagacccatcagctctctctttgcaccatatccagagctatcttctttcactctcctatcaccccaagtcaagccatttttatataatccttaaaccacagacattttctcccaaattgatatcttcttcttacttccctgtggtcttctcaccagtgtcctaagagtaatcctttgaaaagataaatcaagtcataatactgctctcttagccctttaatagaattccttcaaaagtgggatagaatcccaagccatggtcacatcttgtaagcccctaaacagcatctgacctggtccctctttctgagcttaccttctgccactctctccttgccttctctgctctagacatgcagactttcttgctgttactcaaatatgccaaactcacccccatccctgaactttatcgttctttctgttggaacattcatttacagaccttcacatggctaattcccttgcttcattaaagtctttgctcctatattaatcctcagagattatttccttgaccaactcataaaacataagactcctcacctccccagccttcatcactttgtgagccctgattcgatttcatttttcttcattacaccctcagtctgtcaccctttccttattagaatacagtctccattagagcagagaccttggtttttgttaagagtgatatactcagtgcctagatcagtgcctgacacattaattgtccccccaaccccaataattgctgaagaatgaatgaatgagtgagtgctatttttaagatcaaaggagagaagataaaccattaatttagtaccatataaagcacataaacatataataggctgtcaataaaatgagagttgaattcatagcacaacagcaccctacagcctttctaccatgacacttatgttttaaaaattttattaacatgtttttgttgagatacagttcacacattatcaaagtcttctttctaaaacatacaattaagtgatttttagttgtttcacaaagctgctcaatcatcactgctatctaagtctagaatatttatgttaccccaaaagaaaatttagtgtccattagcagtcacttgtggcagtctgccacagttactacttgaggccatcactatgacagttactgctgttactacttgagatcatcattacaagactgaacgaaggaggacaaacatagaaatgaaaacttaaaacaaaagaaactgttttaaagaaggggtccggggaagaagaagagggctccttgcttctagtgagcaaaggcagcagcagccctgagcttctacaacccttcatatttattgaggagaaagagcagggaggaggaagtaatgattggtcagttgcttgattgatcacaggttcccattattgctaacaggcctcagatgtgcgtaatcacaagaaacacttgtgactgggtcgtgacagccctcagcattccttctgggtgacagatgcagtttgtcagtttgccagcattctgcatttatgagaacagtttgctgtttactcatatagcctccagtggtatactgagttgatcatgaccctcactcttttggtctccaacagtcactcccatagtacctcttctcagcccttgataatctaataagccactttctgtttctatggagtttgcctattctggctattttatataagtataatagaatcatagaatatgtgcctgtttgtatctggcttctttcacttaccatgatgttttaaaggttcattcacattgtagaatgtatcagtactttggacttttttatagctgaatagtattccattatatgaaaacatatgtccacacataaacttgtacacaaatgtttatcacatagcattacccataatagccaaaaggtgaaacaaaccaatgtttatcaattaatgaatgaattttttatttagggagctgggagctccctaatggcaggaactgtgtcttattcacagttttgtacataagagatgttaggtaaatgtttatgtaatgaataaataaatgcatagctatgactactataataatatgcaataattaactattatattgacaataatgataataacaatattcagaatgatggaaattactgcttgattgaccttgttaggtttctgattctttagatttcagtccatttatcaataaaattgggcttatagtgatggttaacatgagatcagggatataatcattattcctatgcataaggttagttccccattgcaatccactttgccagaactgccatatgtgtcataacaacaggcgatcgctgggcatttaagatatgtattactaaccaagagtaaagtttccaccgcttgagaattctgtgtatcaaagttccagttctttaggatgaaaattatacttattctcttggatagtataaagttagttacaaaatgttatgaatctctgaggaaaagttgaggtaatacatattttagaattttaatgtttgttctatgtttttctaatttcaataaaatcactaaatcacaagattcctaagttgaggctatatctttattgttgtgactttagtgacaagcagagtggttagcacttagtaggtacccttttaatgttttacagatgactaaagagacagtatttgatataaaaaggtgtgaacccaatgctccacagattttgttcaaagaaataccagcagcagtgaattgaggcagagccattgaaggaaattacatctctgggacaagagctttttcccagctggacttctttttgaaaaaggggtatgacctcacacacacaggcagaccctcttccactgcaccatggcgaggcaggcagagactcatccacccaggctctgggtgactagcttgctgcaggagcaagccctatcgtgggacatcaattatataagccacagcatttcagactgagggacaaaagtagattatttgtggtggggacagagacagtcattttaagcaatatcttaaatgaaaagccagtcttcgtggctgagctttggggagactaacctcagagccatatggctgttgggaatggggaggctaatttcatctgtaaaatgataggcctggatgagataataatcacttttgtctctcccagccctgaatactctgtggcttctccaagaaactctaatgaggggaatgtagaatcccagaacacccatggccttaggagagccttgagagatctatgcactgccctcagggtactgctgagggttttttgactttttctgtagctgtgtacatccagtttctctctctgtgtgagttcagagcccctcctctgctcactcatgctcacctatgcgcacctctgtgtacacacatgttacctacacaacagagctgtggtccctgagggaggaagattttcagttaagctctagtttccgaagctatctctgtcactgctgtcactggtgtgcttctaaagcagaactctaacttccatctgtaaaattttctatagcatccattgccgttgggttgaagtcgaaatccttgtcactgcacccaagtcccttcaggcagagggcagccaacatcttcaggaccatccctagcacccatttcctcagaatttcttctccagctgaaatgaatgattctttccttccttccttccttccttccttccttccttccttcctccctccctcctttcctccctcccttccttcctttttccctccctttccctcctcttttctgcccttcctccccactcatgtcccctcccctctcctcccctcccctcctctcccctcctctcccctcctctcccctccccttccatcccctcccttcccctccccttccttctctccttctctcctctcctttccttcctttccttaccttctttcctttctcttcttccatccctcctttcttttctttttttctttgtttcttccttcctacctaccttcctttcttccctttttcttcacatagattatgtcttctctcatctggagcctttgcaaatattgcttgttttatgctttcacaagaacatgagtgatttttaaatatgtaaatctgaccacaactctctcctgctaaaccctgaatggctccacatcatagttagaataaaattcaaacatctcaccctccctatgtggccttatggaagctggccttgccttccttcttcacacagttttatgtcctctttggcctccctgtaacagccatagtcaccttctttttgtgccaagaacctgctacacctgctctgaaagtcagaatttcatgctagcacttctctttgtctgcaggttattggttcccatcactgcctggctggtttcttttcctctctggtttcaactgaaaaggaacttccttagagaggacttttttgtccacagaatctcaagtagcttatttcccctgaagtctgctttatttccttcatggcacaaataacttgttgatattttgttaataatttatttttggtcagctggctgaagagttgacactataagatcaaaaatcttgtctatctcattcaagactctatccccagtgtctcaaacagttgttcctagaacatactaggtacttaggacttgtttgttgaatgaattaatgaattaattaatgaacaaatgcttgaacatctattactcagcttttcctttctttcacatgaataacttctatgtatcttttagctgcttatttaaacatcacttcctcctggaagcctttccggaccctggaggatgagctagatgatcctcacctgtgttcccttagcagccaaatagatgacgggattggggagattaattgcacctgtaaaatgataggcctggatgagataacaatcactcttatctctcccagccctgaacactctgcggcttctctgagaaaccctatcgaaggggatgtggaatcccagagctactcttgctatcaactcgccgcatgaccttgggaaaatcatttcacctggttcagcaatgatttactgagctattgaaggccttactttccagatccaggtaagattgatgatgctgaagtcttatttcctctcaacttctcgttttccccttgacgatattcttttcaggagcaaaaactgtaacctgtacattgttacattcctggtgcttagctcagttgtgagcagttgagtgattttagaaactcagaataaattatttattctcttgctaaaaatatgacgtgctttctaggtagtcactgtactggcctctatgttaaattctctcaaggaggagaatggagaaccattaatcaaatgcctactaagtgttagtgttttacacaaatattcttcttgtattctcacaaaaggccttaataggagtaaacgctgactccattttataaacgtaggaattgaggctcagaggataattatctggtcgagctagaaaataggagtagtgtcctaactctacaatttctgctctttccactaaaccacggctgtactcccaatggtagggaatgaacaacagggctctcctaataattttattagccattctcaaattaatagctcctctgctggcccctcagaaagggggcttcatttagaagtctagcctcacaagtaagaacaactctggttccaggtacctattgggaagtggctgattgaagccagtgtcactccttgtcaggccccaattggcttgccccttccagtaggtcactcaacgtctgaccccagcagtgttttctagcaactctattctgcccatagataagggaaataaatggagaggcattcatagctggctggtgatgatttgtttgttgaaagaaagggtattggatgcaattctgagtgtactggtgccaggttctttcctccttggcatttaggtaactgccagggcttgtgtctgatcttcatattctccagtctaggcaggaaccagcttggtcaggttgttccctctgctgcttgacaccctgcttgacctctgctgactcatctaccaccctctcttagcatcctcataagttactaatggagttcagggggaagaacagctgccagaaatatgtgggcaaatgaaagtcctacattttaaagacaagttaaagctgaactgttccggataaaccagcagctttgtcttcctgtcggtcctctctaaatactcagtgtaaaaactgctgccttagtgagaactcttcctcactctggaaggagctttctctccttccacagagtctcgcccttggatagttacacgtagtcgtcctttctttttcattgttgatggggacagatgtcagagaaccggggtacaagtcaagacacccgactggaggacctactctagttaccaactcgtggcataaccttgggaaagtcatttcatctctttcaacattgatttactgagccattgagtggttcaaatatgtagtggtacgcattgtaatcttaagacgtttctgactctctctctctttttcttttttccttgggaaggttcttgctctgtcacccaggctggagtgcagtggcatgaccatggctcactgcaaccttcacctttcctgctcttgaactcctgggctcaagcaatccttccaccttgagctcccaaagtgctgagattacaggtgtgagccactgcgcccagctgactttttaattttgctattttaaagctatatgaaaagacagagaaaagtgcccacagtatattaagtaggaaaagcaagttgcagtatagtcattagaatatcatacatttgttcaaatgcatgttttcatatcatgtattgttttcataatttaaaataactaccaatacatcataagcaatctttagtaagtttatcatttgattgctcaatttattccaaagcctgtatgactgtctatttaatattagatgtttgagacacagaaaacacaaaaaaactcattgtcctagaggagcctaaagtttatagaatttatgaggacttatgtttcatttctaaaagattttgggaagtttttctgttgaggttgggctgcctctgtgtctgataactaggaagaacaccaacagctccttttctacaagaggtgtattgttcccattctcttcagtgccacatccttgctttagtgcttccactgaccttgtgcttcctgaactcctacgtaaccttagtttgtgtcagtaatgtagtacttaacaatacagcatcttctctccttagcccacctcctcaccatcagctcacctcctcaccatcctttctttccctagcccaccccaatcagtttctgtctgctctgttccactgaaaattttcttgttaaggttacaatgttgaagatgttttgctaaaaaaaaccaaaaggccaaaatccatgcttgcaacaattccaagaaattggtgaattgctgaggatgctgcctttcattctctggtccctgcttacacctgcagtctcacctccactttgcagctttattgtgtctttctcaccaccaaaccttcattcatgctgctctctccctgcctggaatgcccagcttcttcatctccaattagaaaattctcgctcacttttgcagtaaatgcctttctgttttatttctcccaagccttttttttttttttccagtttaggtatcatctatttcttctttccagaggaccctaatttctctttggggaattttatctcccctattgttggcagggataccctgctgatctttaatctaactcatttggtacagtcgtagaatgggcattgacccatgctaggccaactgggctttttcccaggagaatgcataaaatgtatggattcattcatttcagcaggccatctgggtccagatatcaggccatttttgcctccaacaccgtctagtgttacctcttttctatttcaagtctcttttttcgacattgtctcgtggccctcagagctgaccctccgagcttgttcataagctcccaacacatggctttttttcaagttatccaaagttggtttctgctccttgcaattgaacaacaataacaacaacaagaacaagaaaagactgatacattcttctagactcagataagggaataccttctctgcaactttttcaggcttcctcttttgtcccttcattggcctctagttgctctaatagattcctccactgtggcattataactgacctcttctctcctaattatagtctccttttgggggttagagatcatgtctcattccaagttttgttcctagagcctaagacatctttatcttgctggggcccggatcacattcattcaggagtgaatgaagaacctgaaattttgtacctatggggttagtatattctttcttgttgacagagatagcaacctaataggatagttttctctttttaggagctaaaattttatttctgtgtaattatccttgtaagagatttgacaagacctcactaaaggtatgaatgtcctgttccagcaggttctagtcaggaacatggaaagcaaatcagaaatttcaaatagaggggatttagtatagggaatagaccgcatgtattttagaaagttgatgtagcaaacgggatgttgaggtaatccagacatcagtaactgcaggaagtggctgcttctgtcagacagggagaaaaaggagagaaaggtggtgttatgagaacttacacaagtgcaaaggagaaaccctgcatggctgagcctcatacttctggaaggttcctgtgtcttgtgactggtgcttcagcctctgagtgggggcaccctgtggccaggcttagacatcttaaagagtgctcaaagactggaactcaggcctcagggagggcaaatgcttgccagtgctaagaattcggagatgggaactgaaaacttgagttcagacttggtgagccgctcgtgttggtctctaatgaggaatcctgtggcaggtgctgggagtgcgtaaggaagctaaagaacggaaccatagctttcttttcctctggaagcatctaacagggtctgaaataggaagagagtcctcttcatcctgccagcttctagtctcctgtcaatgtcccctgttgcagggctcgaatgggaagtgggctggcaaggagtctgggaagtgtagttttcagaatctcagcttcggtgtcactgagcgtggatgggggtgggaaactttgaggctgagagacactgggtaaataacagacatatgctcttccaggaaaaaaaaaaaaaaaagtagacttggcctccaaggccatgtgatgaaatacagtctccttgttttgtaacctgtttccaacatgattcccaataactctcgagtaagaaattacagcttgggataggacttctgtggaaaaaccctggtgccagtgtaaaaagtgcctccaaagtcaaagcattcctgttagtcccgacacatagagcccatgatttattgtaatttttacttaattctgcctccttctgtaggccctggttccaagaacgtcttttgggcccgatgcctccatggctcagatacttgggaacagcaatttgccataatgtctgctgctcctcaggcctccctgccaaccccctggctgtgtgcagccagccacaccctattcctccagattgcattgctccatgtgttttttcttccttggaaacagaatgccatgtcttaacctatcccatcagcagactctatttctttttttcttcatttttcactactttttgctcatcccttaattctgatgcttggcctatgtccctggattttttttttttttaataacgataatgctcttttcctagaatcttactatataaagagcatcttgtaataacagtgacagtgaaattttttggctccacgaagctttagattactcaagagcttttaaaaatctacaacttcactgattcaatattggggggaaacaggtcatttggattcaattaatgatatttaaatcctgaatctaatttaattagaccacctttatctacttaattcctctgagccttagtttcctctactttaatagagggctaagacctacctctgaagattgctaggaggattaacataagctctgtgctacatctggcacatagtaggacagaataatcttagttctctttcttcaagtgagagtgggtgtggtgctcttatgcatatggagaaaggaggccatataaatctgtcctgagctgtataatggatttcacaataagaacaatgagaaatatctgagcaatgctatttggaggataatttttttttctctgttcctatagaaaaatgggagtgatattatcatcagatgaatttcaattatggactgacttccccaatgtaactttacccctgtacttatctattatttttgtatgtgtgagagagaaaattcggaacaaaagcaccagactgggacaatatggcgctgttcctagggagagaatggtggattgtaagacttgaaagttagtcttgtgtcagactatgcagattcctgaatgcctggctaagtagtttccattttatttcttaggcaatagaaagttgaaaccaaaaagggtaaaataaataaatgaataaataaataaagaaccttgtaaaatgaatttgacattttatataatagctcttacttgaggaatgacaggtaacaagattcagaaaaatgtaagatccaaggagattcatctttggtgagaccttttttttctttaaaggactttaggaaagacatacttaaagtaagtgctagtagatgaggtgttcctttcattttattttccattttttcattcacataaatcatgacttgtcattgtttgcttcaaacacaggagagattttacctgtgggtttattctgttagaatttgtctatttgttgtagagcaggatcattgctgcatttgctaacattctgggtgaggagaaagatgcataaagagatcagggtaaccaacatggtaagcctaatgacaaccacaggcagatatgagtccctcaaggggggaatttagggcttcaggaaaagctttctgaaaacacgcacacaacaacagaaaaagatgagcgagccaagtcttagggaatgaggagtcatcatccatgtggaggaagaacagagggcaccacaatccacatggaggaacaatctgagcaagtgcacagagataagacacaccacactacctgaggacactacaagcaatttgtgattctggagggtagcaaagcagagagagtgaggagagaggagctgaggagtaaggcaggaccaggaggaagaagttcttgtgtgctcagccaagaaggttacactttatcctgccagtgatgtggagatgttaaaggtctctgagcaggtgagtgacactgtagaatttgttttattctgttctggtggctgcataaaagaaggaaaaagatgataggagagagaccagattggaggcattgacaataacctatgtaggcatgggaggcaaggactactgggggccaccatggagtatgaaactagggtctgtgggagttgatgactgagtgaaacagggaggtaagacatactgaatgacgatgagtctggccatgatgactggtgaacgaggttaccaacaccaaaacaaggaacacaaaaggaggttccatttggggagaaagacaatatgttaggcttaggaaaggatgggtttgaggtgccttgagaatgtagaaaactatactcctaaatcaacaggcagtaattggtagaccttgggtaactcattttatcctctgagcctcaatggactcatccttttagaaggacacaataatatctagtttccagggaaagatcaatttgcccagtgaactcaaagggttgcttttatcaaactcttttcattagcaccatctttacattaatttataaggaagaaacaaacaaacttctctttctaaaattgaccacttctcccttctgagccaaggatgctctgttagtcatcttaagcttcagaagtttttctaccctttaggactggcctttgagctttatatgtgtccatgtgtaatattctttctgtttagtcttcatatcaaggtgacaggttacagcatgaaggtcctggggtggatatatcctttttgagaatacatatcaacaaattcaaaagtctggagaagtaaaggtgattcagaaagtattttgaaatttgtgaaagttttccaaataatcttcatatttatttatcccatatcatatttccaaaagttgtaaaatgaattttactgttaaatattttgtccttcttttccaaaataatgataaatagctttctcatctctgtaaaagccatctattttggactcaaagcttccttggactcaaagtttcctttttatttattttttcagtggcaggacatgaaggggacagagcgaaaaccctcagcccacatttactactagtaagccatgaaataaacaagtcctgaccatccttaccacatgttttcttggaacaaaagggatgtgggtatgacagatccaacttttgctatgaactgtgaactagcatatttttaacttggcttctgaggttggtgaaggaaactttcttgtcctttgctaataaaatgcagatggttcttcttccaaagttcctaaatccccaaagtctgaatctcatcttcttcaaggataagaatagatttgtaattcagtaagcctcaatgggcatcatcaccattcttccttccagatagctttttaaagtgcttgacatataataagtattcactaaatatgtattgaatgagtatataagaagacattgccaggcgcggtgggtcacgcctgtaatctcagcactttgggaggccgaggtggatggatcatgaggtcaggagctcaagaccaccctggccaacacagtgaaaccccatttctactaaaaatacaaaaaattagctgggcgtggtggcaggcgactgtaatcccaactactcaggaggctgtggcaggagaatcacttgaacctgaagcagggcggaggttgcagtgagcggagatcacgctacagcactccagcctgggcgacagtgtgagactcggtctcaacaagaaacaaaacaaacaaacaaaaaaagccacattatcagtaagcttagagtctgagctcttagtgtaaatcctggcattgcaggccattatcaagaatgggagaaattaccgggcaccatattagaagaaagaccttgaagtcagttaggtcaggattaggatcctggttccacctgtcctaggcacatgtagggaggagttgggtcaaaaaacatagctgctctgagactccatatggtgtagtggttaaacatcagggcttttaatttgaatactggttctgtcataaattatctagaggaccttgggccatttactcaaacgtctttgttttttgacctttaagtggagagaataattgtacctattgttataagtttgctgtgaggatttatgagttaatatacacaaagcacttcagtagagcatgggacacagtaaggactttgtatgagttaactattattctgttatttttattctactacctcgtgctactacagagtgctactctgtgagaatgtacacttcttttcctatggacaggttccatagttttcaacatcatgatagtggtattgaggcagtcatttaacctcagccacttcgggttttagttttcagacatgccaatgagacaatgcttcctatccctgctggatagataaagcataggctttttgtgaggcgcaaataagattgcaaatgtgaaaacacttagctgactctcaaatgctctataaatgtgagtttattagttggaactctttctactacaagtgacaaaaattcaactcaaatcagcttatgccaaaaaaataatttattggttcttgcagctggattctagggtagctcaaagacttgaaggaagaactttaagaactaggacattgggaacccaaattgatggccattgtaactggaatacacagtttatacctatctgttatctctgatggctgcattctcctctacacagccctctttgcacgtaatgaggaagatagcaccagaaacctcgcttcatattactttaagattccaagccagcaatatatatatatagcaatatatatatatagcaatatatatatatatatagcaatatatatatatatatgattaatttaatctcccttctaaccttggattgattgttgggtacatattaaatggaaaggattgtggcccaacttttttagcccttggtcacaactctttccatttaatatgcaaagaggaatatattaccagaagaagaaataaagaggaaaaaaggtactgggaagattttttttaaaaattactctcatagattatcactactaacattggtttctttaacttctgtagagatgactacaatgaacctctctgtgtaagtgaaagactagattaaatatactccaagcccttgagtgttttcaaatttctggccgagacaggttatcaaaatattgatcccattagaagttgtctttgtaaaagaggaatcctacccacagagtggtcttaacctttgaactattgaccttttgggctggaaagttctttgttgtggaggactgtcctgcacatcctaggatatttacagcattcctggcctgaagatgccagtagtaacttctccctctctatgataacccaaaatgtttttaaacattgacaatatcccctaagggacacgccttcccacccctgcctttgagaataattgtactagtggaacacagctaagcagtaattcatacttctctattctccactcttattccaaaatgatgggtgtaatgctggccagctagactggttttataactttttaaccttcctttgttccctctctacacatttcattacactgaactaccccaccaatggacatttgaaaggtcatattgttgaaaaagactgcagggcacgtgactcaggatattttgggtactagtccttcttctgccactgacttggggtgtgtagctgggcatctctttcctctctgggccttggatttccatattggcaaaaactgaaagatgtcctgtaatttttcgtgttactctagcatttatgatacaattggatgagatatgaactatgaaatgggaaatcaccctacatatttcattagttgaatagtttgtgattaagagtctaagtttctcacaagcatctcttttgtttcttggaagttaagatcgcacctggttgcttgggatgtacagggagtctgggcaaaagcaaggataggtgtattagtctcttatcatgctgctaataaagacatacttaagactgggtaatttataaaggaaaggaggtttaattgactcacagttcagcatggctgggaggcctcaggaaacttacaatcatggctgaaggggaagcaaacacatccttcttcacatggtggcaggaagagaagtgagtgagtaaaagggagaaaagccccttataaccccatcagaccttgtgagaactcattatcatgagaatgtcatggagggtaaccacctccatgataaaattaccttctattggttccttccatgacatgtggagattatggaaactacaattcaagatgagatttgggtggggacacagccaaacaatatcaatgtgcttatagcagggtctttgctgctacttgatgttttgtctctgaagattccatctgtggctagaaaaaacagtatgaagtggaaaaccattcactgatactgaagcataatgtatgaggggctggaatagtaagaaatacagtagaggactgtgcagggccttggatgccagggtaatggacacaacactgatacccaaagaggggggtaaggtagaatgcataatggaacaaatatccatgtaactgggtgaattatttctcatctttatgtttaaagttcagaaagatggtagagtagaattagccagatgcattttggagtagataatagtttgctgcctctttatttttcccatcaaaattaaatggcttccaatattcacataattgagaaaactgaggctcaaaaaggaggagtttacaactccacagtgatcacattgtgagttagtggcagagtggagacagccagccaggcctcagaacaccctcctcttgccttatataattaattcaataaaaggagacacattgatgctggtttttccatcttgctttcctatacctccccattcttgggagggtttttcactaagatttcagtattattgttgccatttactcctagctagaggcatcagaactaataaggtctagaacagagttcatggagcaaatgtctcctctctacttggctgaaaaaaaaaacaaaaggaaaggaatgaagatgtcagttgtgttttcagaatgagctttccagcagatggagatgggaacctatatatatttttctaacactatcttctagtttctagttcctgtattagtttccagtgcccaccataacaaattactacaaatttcatggcttaaaacaagagaaatttattatctcaggtcctggaggccagaagtgtgaaattactgttccttgtctctcccagcttccagtggttcccaggtgttccttggctttggccagatcattccaatctatacctctatggtcatccttcctcctttttttctctgtgtgtcttttataaagacacttgtcactgtattaagcgtccagtcagataatctagaatgatctcttaatcttgacagcttcaatttaattacatctgcaaagaaccttccccaaataaggtaacaatcacagattttgagtattaggacatagatatatgcttctggacaccaccatttaatccactacacacaggaactgtatgtacagtgtctcatcagctcctcacaagtctgtgagttgtggatatatataagcattggcttttgttgttaaattcattttaggatgaaaacatgcagaaaagaagggtttttttttttttttttttttttgagacagagttttcctctgtcacccaggctggagtgtaatggcttgatctcagctcactgcaacctccacctccctggatcaagtgattctcctgactcagcttcccaagtagctgaaattacaggtgcccaccaccccacccagctaatttttgtattttagtagagatgacatttcacaatgttgaccaggctggtctccaactctcggcctcctaggaggccctatctttagaggacatatatacagatacactatgttgaataggggattcccattagggtattgagtttgacccaattattattctcttaacggtttaaaggaaccttgactcaactctgaccccgtctctatttagctgtgaataatttttaatgagtctgtttgcctcttgctcctcagattttccaagtgtgaaacgagcaatctgaactatgagctctcacttagtttatgagtcaaaccttccatcaaaatcagtcctgaagaccaaggttttgaaggaataatgccatctttacaagtgtaacttttgctgaaaatattcaaactcttcccactacgactcaactagtgatacaaaatccaattgctaggaagctttaggattcaccctggtgaggaccatcttccctgaaatactcttttcttctaggctatacctcttatttcaccttcaaaacccatcttaagtattcctccttccctgatcttcctaggcaaaattcactaatcttaccatcccctttcccctcccctcaatactttatgttgtgcatgcttgaatagtgacacttatctttatatataattattcctttttcttatctcactcttctaaagtgtgagtaaatgcatgaggtactcttaatattctttgagaagatgtcaagatgaggaacctacactctcacttttcttcttgatagttgattggaagagtgccagagctgttagaggaagaaagtctgagttagtgaaatacagaagacattttttaaaagaagtctagtgctgtttttcctttgtgaaagaaattgcttctttgtttttttcctcttgtctttgctttccctcatccttttctttctgttttttaccgtttattttcatcctctatcaaacatgcatgctgagctctaactaatttgcagttactcctacgcctaaagataaagagataaataagccactgtcctgccatcgaatagctcatagtctcatggccaagatagttgaggaaataattacagcacatcatactatatcatatcatttcatatatgacatatatactagttaacatggtacaatcattgtattacatatttttacatataattttaatctataatatgtaccatattatacactacaaggaggatgtgccaatgctttagcagtcctcctcctggctttaggagaagccatatagaaaatgtgttagaaaatgaatgtcttcatcagacaaaaaaaggaaatttagaatggagcacactcaaaatctcagagactgtgaacttgaaaagcaaacccaggcagatatatgataatcaaataaaattttctatgtccacttttttcatggaagagctatttttaaggcttacttgggggttccagttcccacggtagatgttgtacctccactagctctgcaagacagtgggctgtgccaacatcatcatctgcctaccattcagatctccatccaaagcagacagcaggatactagcaagctgagactgagcatatcacccttctccctgaacactcagcctagtttgcattagtccccttctctgctacttcagactccacagaaaccatgtgtctttccattgcaaagttaatttgcaaaacactcaataaacttctaattttattttattttcctgggatctgatgttgcaaataaaagaaaattataaaatgggggcaattactgattgggctgttattgattactgtgttattttaataccaccaatagccattaattatcaggtcataaaggtacaaagcataagctgatttatcataatatccctgtatctttgactgtgcttggcataaattaggtaaccagtaaatgagaattaaattcagttgagcaagtttgaaggattaaatgaagcaggcattattcattttctttatatatcagaaatggatcagaatttaaccaagaagggagctgacattccccttgtggtgtgctagttagtccaggagctatttcttatggtacgaaacacacatactctcctgttggggtgtttctgtggctgacttgatggaggtctgcgtgcatgacctttctcttttcagccctcctctcctgcattgcatcttacttcatgctactgactataaaatctttctgaaatgcagattagatcacctgtccaagattctgtttattttcataccatttgtgatggttaatactgagtgtcaacttgattggattgaaggatgtaaagtattgttgctgggggggtgtctgtgagggtgttgacaaaggagattaacatttgagtcagtagggtgggaaaggcagacccatccttaatctgggtgggtaccatctaattagctgccagcatggctagaatataaagcaggcagaaaaatgtgaaaagactggcctggcctagcctcccagcctacatctttctcccatgctgtatgcttcctgttctcaaacactggacttcacgttcttcagctttggggcttggactggcttccttgctcctcagcttgcagacagacggcctattgtgggaccttgtaatcgtgtgagttaatgctacttaataaactcccatatatataggatatatatatatatataaaatagaatatatatatatcctattatatatagatatatatataaaatgggatatatgtatataggatatatgtgtatatcctattagtttataggatatatgtgtatatatatagatacatctatataaaatgggatatatgtatataggatatatgtgtatatcctatatatatatacataaatatatcctattagtctgtccctctagaggaccctgactaatacacgatttaagaaaattgtagtgagaacacttaacatgagatctatccttatacgaaatctttaagtgcacagtacagtattgttaattataggcataatgtttacagcagatatctagaacatttgtcttacatagctgaaaccctatactcactgaacacaactcatttctcctctctggcccctcacagccaccatttggttgtctgtttctatgagttttactattttagatctctcacagaattagaatcatgcagtatttgtccatttgtgactggattattttacttagcttcagtgactggattattttacttggctttacagagtttattcatgttattgtatatggcaggatttatttctttttttaaggctgaataatattccggtgtgtgtgtgtgtgtgtatgcaaatatacgtatttttaaggctgaatatttcattgtgtctgtgaacacacacacacatacacatatatagacatttaggctatttcttggctactgaataatggcttgaataacatatattagcttgaataaatgctgcaatagatatggaagtgtatatatttctttcagatcttaattttaattcttttggatatatacctagaagtgagagggctaggccacatagtaattccatgtttaattttttgagggaacttcacactattttccacagcaactgcaccatttttacattcccaacagtgtacaagggttccaatttctctatattcttgccaacatttatcttttttctgataatagacattctaatagttgatattttattgtacttttgattgcattctctgatgattaatgatagtgagcatgttttcatatacctattggccatttgtatgtcatctttggagaaatgtctactcaagtcctttgcccatttttaaatcgttatttatttatttattttgctattgagttgtttgagtttcttacatatcttagatataaataccttgtcagatctttggtttgcaaatattttctc
